United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 7

SEQ ID NO: 10068 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10069 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10070 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10071 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10072 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtggcggaggcggaagtggaggcggaggatctggcggcggaggctcttgagagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10073 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtggcggaggcggaagtggaggcggaggatctggcggcggaggctcttgagagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10074 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtggcggaggcggaagtggaggcggaggatctggcggcggaggctcttgagagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10075 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccgcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtggcggaggcggaagtggaggcggaggatctggcggcggaggctcttgagagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10076 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10077 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10078 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10079 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10080 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10081 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10082 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10083 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10084 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10085 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10086 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10087 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10088 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10089 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10090 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10091 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10092 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10093 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10094 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10095 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10096 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10097 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10098 - DNA, 1524 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10099 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10100 - DNA, 2052 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10101 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10102 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10103 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10104 - DNA, 2634 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10105 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10106 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10107 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10108 - DNA, 2637 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10109 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccggaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10110 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10111 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10112 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10113 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10114 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10115 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10116 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10117 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10118 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10119 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10120 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10121 - DNA, 2691 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10122 - DNA, 3723 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10123 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10124 - DNA, 4218 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10125 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10126 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10127 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10128 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10129 - DNA, 2124 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10130 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10131 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10132 - DNA, 1524 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10133 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccgcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10134 - DNA, 2052 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10135 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10136 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10137 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10138 - DNA, 2634 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10139 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10140 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccgcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10141 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccgcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10142 - DNA, 2637 bp, Artificial Sequence
  Synthetic Polynucleotide encoding a CAR with optional accessory module(s)
atggccttaccagtgaccgccttgctcctgccgctggccttgctgctccacgccgccaggccgcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10143 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccgcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctggcggaggcggaagtggaggcggaggatctggcggcggaggctcttgagacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10144 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10145 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10146 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10147 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10148 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10149 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10150 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10151 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10152 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10153 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10154 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10155 - DNA, 2691 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10156 - DNA, 3723 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10157 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10158 - DNA, 4218 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10159 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10160 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10161 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10162 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10163 - DNA, 2124 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10164 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10165 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10166 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10167 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccggaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctggcggaggcggaagtggaggcggaggatctggcggcggaggctcttgagacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10168 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10169 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10170 - DNA, 2700 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10171 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10172 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10173 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10174 - DNA, 2550 bp, Artificial Sequence
  Synthetic Polynucleotide encoding a CAR with optional accessory module(s)
atggccttaccagtgaccgccttgctcctgccgctggccttgctgctccacgccgccaggccggaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctggcggaggcggaagtggaggcggaggatctggcggcggaggctcttgagacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10175 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctggcggaggcggaagtggaggcggaggatctggcggcggaggctcttgagacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10176 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccggaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctggcggaggcggaagtggaggcggaggatctggcggcggaggctcttgagacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10177 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccggaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctggcggaggcggaagtggaggcggaggatctggcggcggaggctcttgagacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10178 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10179 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10180 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10181 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10182 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10183 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10184 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10185 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10186 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10187 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10188 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10189 - DNA, 2682 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10190 - DNA, 3714 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10191 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10192 - DNA, 4209 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10193 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10194 - DNA, 2019 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10195 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10196 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10197 - DNA, 2115 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10198 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10199 - DNA, 1980 bp, Artificial Sequence
  Synthetic Polynucleotide encoding a CAR with optional accessory module(s)
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10200 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10201 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctggcggaggcggaagtggaggcggaggatctggcggcggaggctcttgagacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10202 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10203 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10204 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10205 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10206 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10207 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10208 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctggcggaggcggaagtggaggcggaggatctggcggcggaggctcttgagacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10209 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctggcggaggcggaagtggaggcggaggatctggcggcggaggctcttgagacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10210 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctggcggaggcggaagtggaggcggaggatctggcggcggaggctcttgagacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10211 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctggcggaggcggaagtggaggcggaggatctggcggcggaggctcttgagacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10212 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10213 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10214 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10215 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10216 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10217 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10218 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10219 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10220 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10221 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10222 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10223 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10224 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10225 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10226 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10227 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10228 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10229 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10230 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10231 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10232 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10233 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10234 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10235 - DNA, 1518 bp, Artificial Sequence
  Synthetic Polynucleotide encoding a CAR with optional accessory module(s)
atggccttaccagtgaccgccttgctcctgccgctggccttgctgctccacgccgccaggccgggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggcggaggcggaagtggaggcggaggatctggcggcggaggctcttgagacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10236 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10237 - DNA, 2736 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10238 - DNA, 2700 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10239 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10240 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10241 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10242 - DNA, 2550 bp, Artificial Sequence
  Synthetic Polynucleotide encoding a CAR with optional accessory module(s)
atggccttaccagtgaccgccttgctcctgccgctggccttgctgctccacgccgccaggccgggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggcggaggcggaagtggaggcggaggatctggcggcggaggctcttgagacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10243 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccgggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggcggaggcggaagtggaggcggaggatctggcggcggaggctcttgagacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10244 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccgggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggcggaggcggaagtggaggcggaggatctggcggcggaggctcttgagacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10245 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccgggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaggcggaggcggaagtggaggcggaggatctggcggcggaggctcttgagacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10246 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10247 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10248 - DNA, 1914 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10249 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10250 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10251 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10252 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10253 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10254 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10255 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10256 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10257 - DNA, 2682 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10258 - DNA, 3714 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10259 - DNA, 3234 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10260 - DNA, 4209 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10261 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10262 - DNA, 2019 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10263 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10264 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10265 - DNA, 2115 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10266 - DNA, 2163 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagggcggaggcggaagtggaggcggaggatctggcggcggaggctctggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10267 - DNA, 1980 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10268 - DNA, 1533 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10269 - DNA, 1536 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttgatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10270 - DNA, 2061 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10271 - DNA, 2754 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10272 - DNA, 2718 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10273 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10274 - DNA, 2643 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10275 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10276 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttgatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10277 - DNA, 2616 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttgatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10278 - DNA, 2646 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttgatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10279 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttgatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10280 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10281 - DNA, 1902 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10282 - DNA, 1932 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10283 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10284 - DNA, 1917 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10285 - DNA, 1980 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10286 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10287 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10288 - DNA, 3411 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10289 - DNA, 3261 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10290 - DNA, 3249 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10291 - DNA, 2700 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10292 - DNA, 3732 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10293 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10294 - DNA, 4227 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10295 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10296 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10297 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10298 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10299 - DNA, 2133 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10300 - DNA, 2181 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaggcggaggcggaagtggaggcggaggatctggcggcggaggctctcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10301 - DNA, 1998 bp, Artificial Sequence
  Synthetic Polynucleotide encoding a CAR with optional accessory module(s)
atggccttaccagtgaccgccttgctcctgccgctggccttgctgctccacgccgccaggccgtctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10302 - DNA, 1500 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10303 - DNA, 1503 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctggcggaggcggaagtggaggcggaggatctggcggcggaggctcttgagacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10304 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10305 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10306 - DNA, 2685 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10307 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10308 - DNA, 2610 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10309 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10310 - DNA, 2535 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctggcggaggcggaagtggaggcggaggatctggcggcggaggctcttgagacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10311 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctggcggaggcggaagtggaggcggaggatctggcggcggaggctcttgagacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10312 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctggcggaggcggaagtggaggcggaggatctggcggcggaggctcttgagacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10313 - DNA, 2562 bp, Artificial Sequence
  Synthetic Polynucleotide encoding a CAR with optional accessory module(s)
atggccttaccagtgaccgccttgctcctgccgctggccttgctgctccacgccgccaggccgcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctggcggaggcggaagtggaggcggaggatctggcggcggaggctcttgagacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10314 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10315 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10316 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10317 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10318 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10319 - DNA, 1947 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10320 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10321 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10322 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10323 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10324 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10325 - DNA, 2667 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10326 - DNA, 3699 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10327 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10328 - DNA, 4194 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10329 - DNA, 3192 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10330 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10331 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10332 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10333 - DNA, 2100 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10334 - DNA, 2148 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10335 - DNA, 1965 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10336 - DNA, 1497 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10337 - DNA, 1500 bp, Artificial Sequence
  Synthetic Polynucleotide encoding a CAR with optional accessory module(s)
atggccttaccagtgaccgccttgctcctgccgctggccttgctgctccacgccgccaggccggctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctggcggaggcggaagtggaggcggaggatctggcggcggaggctcttgagacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10338 - DNA, 2025 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10339 - DNA, 2718 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10340 - DNA, 2682 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10341 - DNA, 2577 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10342 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10343 - DNA, 2556 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10344 - DNA, 2532 bp, Artificial Sequence
  Synthetic Polynucleotide encoding a CAR with optional accessory module(s)
atggccttaccagtgaccgccttgctcctgccgctggccttgctgctccacgccgccaggccggctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctggcggaggcggaagtggaggcggaggatctggcggcggaggctcttgagacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10345 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccggctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctggcggaggcggaagtggaggcggaggatctggcggcggaggctcttgagacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10346 - DNA, 2610 bp, Artificial Sequence
  Synthetic Polynucleotide encoding a CAR with optional accessory module(s)
atggccttaccagtgaccgccttgctcctgccgctggccttgctgctccacgccgccaggccggctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctggcggaggcggaagtggaggcggaggatctggcggcggaggctcttgagacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10347 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctggcggaggcggaagtggaggcggaggatctggcggcggaggctcttgagacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10348 - DNA, 1851 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10349 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10350 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10351 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10352 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10353 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10354 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10355 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10356 - DNA, 3375 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10357 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10358 - DNA, 3213 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10359 - DNA, 2664 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10360 - DNA, 3696 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10361 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10362 - DNA, 4191 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10363 - DNA, 3189 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10364 - DNA, 2001 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10365 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10366 - DNA, 1851 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10367 - DNA, 2097 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10368 - DNA, 2145 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10369 - DNA, 1962 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10370 - DNA, 1500 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10371 - DNA, 1503 bp, Artificial Sequence
  Synthetic Polynucleotide encoding a CAR with optional accessory module(s)
atggccttaccagtgaccgccttgctcctgccgctggccttgctgctccacgccgccaggccgcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctggcggaggcggaagtggaggcggaggatctggcggcggaggctcttgagacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10372 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10373 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10374 - DNA, 2685 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10375 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10376 - DNA, 2610 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10377 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10378 - DNA, 2535 bp, Artificial Sequence
  Synthetic Polynucleotide encoding a CAR with optional accessory module(s)
atggccttaccagtgaccgccttgctcctgccgctggccttgctgctccacgccgccaggccgcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctggcggaggcggaagtggaggcggaggatctggcggcggaggctcttgagacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10379 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctggcggaggcggaagtggaggcggaggatctggcggcggaggctcttgagacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10380 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccgcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctggcggaggcggaagtggaggcggaggatctggcggcggaggctcttgagacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10381 - DNA, 2562 bp, Artificial Sequence
  Synthetic Polynucleotide encoding a CAR with optional accessory module(s)
atggccttaccagtgaccgccttgctcctgccgctggccttgctgctccacgccgccaggccgcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctggcggaggcggaagtggaggcggaggatctggcggcggaggctcttgagacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10382 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10383 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10384 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10385 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10386 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10387 - DNA, 1947 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10388 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10389 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10390 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10391 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10392 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10393 - DNA, 2667 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10394 - DNA, 3699 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10395 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10396 - DNA, 4194 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10397 - DNA, 3192 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10398 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10399 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10400 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10401 - DNA, 2100 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10402 - DNA, 2148 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10403 - DNA, 1965 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10404 - DNA, 1524 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10405 - DNA, 1527 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctggcggaggcggaagtggaggcggaggatctggcggcggaggctcttgagagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10406 - DNA, 2052 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10407 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10408 - DNA, 2709 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10409 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10410 - DNA, 2634 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10411 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10412 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctggcggaggcggaagtggaggcggaggatctggcggcggaggctcttgagagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10413 - DNA, 2607 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctggcggaggcggaagtggaggcggaggatctggcggcggaggctcttgagagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10414 - DNA, 2637 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctggcggaggcggaagtggaggcggaggatctggcggcggaggctcttgagagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10415 - DNA, 2586 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctggcggaggcggaagtggaggcggaggatctggcggcggaggctcttgagagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10416 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10417 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10418 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10419 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10420 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10421 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10422 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10423 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10424 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10425 - DNA, 3252 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10426 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10427 - DNA, 2691 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10428 - DNA, 3723 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10429 - DNA, 3243 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10430 - DNA, 4218 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10431 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10432 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10433 - DNA, 1968 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10434 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10435 - DNA, 2124 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10436 - DNA, 2172 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10437 - DNA, 1989 bp, Artificial Sequence
  Synthetic Polynucleotide encoding a CAR with optional accessory module(s)
atggccttaccagtgaccgccttgctcctgccgctggccttgctgctccacgccgccaggccggagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10438 - DNA, 1539 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10439 - DNA, 1542 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctggcggaggcggaagtggaggcggaggatctggcggcggaggctcttgagacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10440 - DNA, 2067 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10441 - DNA, 2760 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10442 - DNA, 2724 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10443 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10444 - DNA, 2649 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10445 - DNA, 2598 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10446 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctggcggaggcggaagtggaggcggaggatctggcggcggaggctcttgagacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10447 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctggcggaggcggaagtggaggcggaggatctggcggcggaggctcttgagacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10448 - DNA, 2652 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctggcggaggcggaagtggaggcggaggatctggcggcggaggctcttgagacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10449 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccgcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctggcggaggcggaagtggaggcggaggatctggcggcggaggctcttgagacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10450 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10451 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10452 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10453 - DNA, 1935 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10454 - DNA, 1923 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10455 - DNA, 1986 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10456 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10457 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10458 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10459 - DNA, 3267 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10460 - DNA, 3255 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10461 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10462 - DNA, 3738 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10463 - DNA, 3258 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10464 - DNA, 4233 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10465 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10466 - DNA, 2043 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10467 - DNA, 1983 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10468 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10469 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10470 - DNA, 2187 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggcggaggcggaagtggaggcggaggatctggcggcggaggctctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10471 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10472 - DNA, 1500 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10473 - DNA, 1503 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctggcggaggcggaagtggaggcggaggatctggcggcggaggctcttgagacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 10474 - DNA, 2028 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 10475 - DNA, 2721 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10476 - DNA, 2685 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10477 - DNA, 2580 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10478 - DNA, 2610 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10479 - DNA, 2559 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10480 - DNA, 2535 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctggcggaggcggaagtggaggcggaggatctggcggcggaggctcttgagacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 10481 - DNA, 2583 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctggcggaggcggaagtggaggcggaggatctggcggcggaggctcttgagacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10482 - DNA, 2613 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctggcggaggcggaagtggaggcggaggatctggcggcggaggctcttgagacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10483 - DNA, 2562 bp, Artificial Sequence
  Synthetic Polynucleotide encoding a CAR with optional accessory module(s)
atggccttaccagtgaccgccttgctcctgccgctggccttgctgctccacgccgccaggccgcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctggcggaggcggaagtggaggcggaggatctggcggcggaggctcttgagacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10484 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10485 - DNA, 1869 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10486 - DNA, 1899 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10487 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10488 - DNA, 1884 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10489 - DNA, 1947 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10490 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10491 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10492 - DNA, 3378 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 10493 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10494 - DNA, 3216 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10495 - DNA, 2667 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10496 - DNA, 3699 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 10497 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 10498 - DNA, 4194 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 10499 - DNA, 3192 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 10500 - DNA, 2004 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 10501 - DNA, 1944 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10502 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 10503 - DNA, 2100 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10504 - DNA, 2148 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 10505 - DNA, 1965 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 10506-10510 - skipped (5 entries)

SEQ ID NO: 10511 - protein, 9 aa, Artificial Sequence
  Synthetic Peptide representing an epitope recognized by  MHC I
IMDQVPFSV

SEQ ID NO: 10512 - protein, 9 aa, Artificial Sequence
  Synthetic Peptide representing an epitope recognized by  MHC I
YLEPGPVTV

SEQ ID NO: 10513 - protein, 9 aa, Artificial Sequence
  Synthetic Peptide representing an epitope recognized by  MHC I
KTWGQYWQV

SEQ ID NO: 10514 - protein, 9 aa, Artificial Sequence
  Synthetic Peptide representing an epitope recognized by  MHC I
NLTISDVSV

SEQ ID NO: 10515 - protein, 9 aa, Artificial Sequence
  Synthetic Peptide representing an epitope recognized by  MHC I
LLLTVLTVV

SEQ ID NO: 10516 - protein, 9 aa, Artificial Sequence
  Synthetic Peptide representing an epitope recognized by  MHC I
LLFGYPVYV

SEQ ID NO: 10517 - protein, 9 aa, Artificial Sequence
  Synthetic Peptide representing an epitope recognized by  MHC I
ILAKFLHWL

SEQ ID NO: 10518 - protein, 9 aa, Artificial Sequence
  Synthetic Peptide representing an epitope recognized by  MHC I
RLVDDFLLV

SEQ ID NO: 10519 - protein, 9 aa, Artificial Sequence
  Synthetic Peptide representing an epitope recognized by  MHC I
SLYNTVATL

SEQ ID NO: 10520 - protein, 9 aa, Artificial Sequence
  Synthetic Peptide representing an epitope recognized by  MHC I
NLVPMVATV

SEQ ID NO: 10521 - protein, 10 aa, Artificial Sequence
  Synthetic Peptide representing an epitope recognized by  MHC I
EAAGIGILTV

SEQ ID NO: 10522 - protein, 9 aa, Artificial Sequence
  Synthetic Peptide representing an epitope recognized by  MHC I
SVRDRLARL

SEQ ID NO: 10523 - protein, 10 aa, Artificial Sequence
  Synthetic Peptide representing an epitope recognized by  MHC I
LLDFVRFMGV

SEQ ID NO: 10524 - protein, 9 aa, Artificial Sequence
  Synthetic Peptide representing an epitope recognized by  MHC I
RMFPNAPYL

SEQ ID NO: 10525 - protein, 9 aa, Artificial Sequence
  Synthetic Peptide representing an epitope recognized by  MHC I
VLQELNVTV

SEQ ID NO: 10526 - protein, 8 aa, Artificial Sequence
  Synthetic Peptide representing an epitope recognized by  MHC I
LVWGAVGV

SEQ ID NO: 10527 - protein, 9 aa, Artificial Sequence
  Synthetic Peptide representing an epitope recognized by  MHC I
YMLDLQPET

SEQ ID NO: 10528 - protein, 9 aa, Artificial Sequence
  Synthetic Peptide representing an epitope recognized by  MHC I
QLSLLMWIT

SEQ ID NO: 10529 - protein, 9 aa, Artificial Sequence
  Synthetic Peptide representing an epitope recognized by  MHC I
SLLMWITQC

SEQ ID NO: 10530 - protein, 11 aa, Artificial Sequence
  Synthetic Peptide representing an epitope recognized by  MHC I
SLLMWITQCFL

SEQ ID NO: 10531 - protein, 7 aa, Artificial Sequence
  Synthetic Peptide representing an epitope recognized by  MPL-161 scFv and CARs
PWQDGPK

SEQ ID NO: 10532 - skipped

SEQ ID NO: 10533 - protein, 640 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10534 - protein, 496 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10535 - protein, 472 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10536 - protein, 421 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10537 - protein, 412 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10538 - protein, 188 aa, Kaposi's sarcoma-associated herpesvirus; identical to SEQ ID NO: 4885

SEQ ID NO: 10539 - protein, 107 aa, Homo sapiens
MAGEDVGAPPDHLWVHQEGIYRDEYQRTWVAVVEEETSFLRARVQQIQVPLGDAARPSHLLTSQLPLMWQLYPEERYMDNNSRLWQIQHHLMVRGVQELLLKLLPDD

SEQ ID NO: 10540 - protein, 338 aa, Human cytomegalovirus
MCRRESLRTLPWLFWVLLSCPRLLEYSSSSFPFATADIAEKMWAENYETTSPAPVLVAEGEQVTIPCTVMTHSWPMVSIRARFCRSHDGSDELILDAVKGHRLMNGLQYRLPYATWNFSQLHLGQIFSLTFNVSTDTAGMYECVLRNYSHGLIMQRFVILTQLETLSRPDEPCCTPALGRYSLGDQIWSPTPWRLRNHDCGMYRGFQRNYFYIGRADAEDCWKPACPDEEPDRCWTVIQRYRLPGDCYRSQPHPPKFLPVTPAPPADIDTGMSPWATRGIAAFLGFWSIFTVCFLCYLCYLQCCGRWCPTPGRGRRGGEGYRRLPTYDSYPGVKKMKR

SEQ ID NO: 10541 - protein, 856 aa, Artificial Sequence
  Synthetic Polypeptide
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10542 - protein, 859 aa, Artificial Sequence
  Synthetic Polypeptide
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 10543 - protein, 596 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRAKRSGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 10544 - protein, 544 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLTRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRAKRSGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 10545 - protein, 775 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLTRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRAKRSGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10546 - protein, 825 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRAKRSGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10547 - protein, 790 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRAKRSGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10548 - protein, 800 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRAKRSGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10549 - protein, 783 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRAKRSGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 10550 - protein, 211 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFL

SEQ ID NO: 10551 - protein, 188 aa, Artificial Sequence
  Synthetic Polypeptide
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSD

SEQ ID NO: 10552 - skipped

SEQ ID NO: 10553 - protein, 111 aa, Artificial Sequence; identical to SEQ ID NO: 3927
  Synthetic Polypeptide encoding a light chain variable (vL) fragment

SEQ ID NO: 10554 - protein, 107 aa, Artificial Sequence; identical to SEQ ID NO: 3928
  Synthetic Polypeptide encoding a light chain variable (vL) fragment

SEQ ID NO: 10555 - protein, 112 aa, Artificial Sequence; identical to SEQ ID NO: 3929
  Synthetic Polypeptide encoding a light chain variable (vL) fragment

SEQ ID NO: 10556 - protein, 112 aa, Artificial Sequence; identical to SEQ ID NO: 3930
  Synthetic Polypeptide encoding a light chain variable (vL) fragment

SEQ ID NO: 10557 - protein, 111 aa, Artificial Sequence; identical to SEQ ID NO: 3931
  Synthetic Polypeptide encoding a light chain variable (vL) fragment

SEQ ID NO: 10558 - protein, 112 aa, Artificial Sequence; identical to SEQ ID NO: 3932
  Synthetic Polypeptide encoding a light chain variable (vL) fragment

SEQ ID NO: 10559 - protein, 108 aa, Artificial Sequence; identical to SEQ ID NO: 3933
  Synthetic Polypeptide encoding a light chain variable (vL) fragment

SEQ ID NO: 10560 - protein, 112 aa, Artificial Sequence; identical to SEQ ID NO: 3937
  Synthetic Polypeptide encoding a light chain variable (vL) fragment

SEQ ID NO: 10561 - protein, 114 aa, Artificial Sequence; identical to SEQ ID NO: 3938
  Synthetic Polypeptide encoding a light chain variable (vL) fragment

SEQ ID NO: 10562 - protein, 107 aa, Artificial Sequence; identical to SEQ ID NO: 3951
  Synthetic Polypeptide encoding a light chain variable (vL) fragment

SEQ ID NO: 10563 - protein, 106 aa, Artificial Sequence; identical to SEQ ID NO: 3952
  Synthetic Polypeptide encoding a light chain variable (vL) fragment

SEQ ID NO: 10564 - protein, 113 aa, Artificial Sequence; identical to SEQ ID NO: 3953
  Synthetic Polypeptide encoding a light chain variable (vL) fragment

SEQ ID NO: 10565 - protein, 107 aa, Artificial Sequence; identical to SEQ ID NO: 3954
  Synthetic Polypeptide encoding a light chain variable (vL) fragment

SEQ ID NO: 10566 - protein, 111 aa, Artificial Sequence; identical to SEQ ID NO: 3955
  Synthetic Polypeptide encoding a light chain variable (vL) fragment

SEQ ID NO: 10567 - protein, 107 aa, Artificial Sequence; identical to SEQ ID NO: 3956
  Synthetic Polypeptide encoding a light chain variable (vL) fragment

SEQ ID NO: 10568 - protein, 107 aa, Artificial Sequence; identical to SEQ ID NO: 3956
  Synthetic Polypeptide encoding a light chain variable (vL) fragment

SEQ ID NO: 10569 - protein, 107 aa, Artificial Sequence; identical to SEQ ID NO: 3956
  Synthetic Polypeptide encoding a light chain variable (vL) fragment

SEQ ID NO: 10570 - protein, 107 aa, Artificial Sequence; identical to SEQ ID NO: 3959
  Synthetic Polypeptide encoding a light chain variable (vL) fragment

SEQ ID NO: 10571 - protein, 107 aa, Artificial Sequence; identical to SEQ ID NO: 3969
  Synthetic Polypeptide encoding a light chain variable (vL) fragment

SEQ ID NO: 10572 - protein, 113 aa, Artificial Sequence; identical to SEQ ID NO: 3970
  Synthetic Polypeptide encoding a light chain variable (vL) fragment

SEQ ID NO: 10573 - protein, 113 aa, Artificial Sequence; identical to SEQ ID NO: 3982
  Synthetic Polypeptide encoding a light chain variable (vL) fragment

SEQ ID NO: 10574 - protein, 108 aa, Artificial Sequence; identical to SEQ ID NO: 3983
  Synthetic Polypeptide encoding a light chain variable (vL) fragment

SEQ ID NO: 10575 - protein, 107 aa, Artificial Sequence; identical to SEQ ID NO: 3984
  Synthetic Polypeptide encoding a light chain variable (vL) fragment

SEQ ID NO: 10576 - protein, 110 aa, Artificial Sequence; identical to SEQ ID NO: 3985
  Synthetic Polypeptide encoding a light chain variable (vL) fragment

SEQ ID NO: 10577 - protein, 112 aa, Artificial Sequence; identical to SEQ ID NO: 3986
  Synthetic Polypeptide encoding a light chain variable (vL) fragment

SEQ ID NO: 10578 - protein, 111 aa, Artificial Sequence
  Synthetic Polypeptide encoding a light chain variable (vL) fragment
EIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIK

SEQ ID NO: 10579 - protein, 107 aa, Artificial Sequence; identical to SEQ ID NO: 3988
  Synthetic Polypeptide encoding a light chain variable (vL) fragment

SEQ ID NO: 10580 - protein, 112 aa, Artificial Sequence; identical to SEQ ID NO: 3989
  Synthetic Polypeptide encoding a light chain variable (vL) fragment

SEQ ID NO: 10581 - protein, 106 aa, Artificial Sequence; identical to SEQ ID NO: 3990
  Synthetic Polypeptide encoding a light chain variable (vL) fragment

SEQ ID NO: 10582 - protein, 113 aa, Artificial Sequence; identical to SEQ ID NO: 3991
  Synthetic Polypeptide encoding a light chain variable (vL) fragment

SEQ ID NO: 10583 - protein, 114 aa, Artificial Sequence; identical to SEQ ID NO: 3992
  Synthetic Polypeptide encoding a light chain variable (vL) fragment

SEQ ID NO: 10584 - protein, 114 aa, Artificial Sequence; identical to SEQ ID NO: 3999
  Synthetic Polypeptide encoding a light chain variable (vL) fragment

SEQ ID NO: 10585 - protein, 113 aa, Artificial Sequence; identical to SEQ ID NO: 4000
  Synthetic Polypeptide encoding a light chain variable (vL) fragment

SEQ ID NO: 10586 - protein, 106 aa, Artificial Sequence; identical to SEQ ID NO: 4001
  Synthetic Polypeptide encoding a light chain variable (vL) fragment

SEQ ID NO: 10587 - protein, 108 aa, Artificial Sequence; identical to SEQ ID NO: 4002
  Synthetic Polypeptide encoding a light chain variable (vL) fragment

SEQ ID NO: 10588 - protein, 109 aa, Artificial Sequence; identical to SEQ ID NO: 4003
  Synthetic Polypeptide encoding a light chain variable (vL) fragment

SEQ ID NO: 10589 - protein, 112 aa, Artificial Sequence; identical to SEQ ID NO: 4004
  Synthetic Polypeptide encoding a light chain variable (vL) fragment

SEQ ID NO: 10590 - protein, 113 aa, Artificial Sequence; identical to SEQ ID NO: 4005
  Synthetic Polypeptide encoding a light chain variable (vL) fragment

SEQ ID NO: 10591 - protein, 113 aa, Artificial Sequence; identical to SEQ ID NO: 4006
  Synthetic Polypeptide encoding a light chain variable (vL) fragment

SEQ ID NO: 10592 - protein, 114 aa, Artificial Sequence; identical to SEQ ID NO: 4008
  Synthetic Polypeptide encoding a light chain variable (vL) fragment

SEQ ID NO: 10593 - protein, 109 aa, Artificial Sequence; identical to SEQ ID NO: 4009
  Synthetic Polypeptide encoding a light chain variable (vL) fragment

SEQ ID NO: 10594 - protein, 108 aa, Artificial Sequence; identical to SEQ ID NO: 4010
  Synthetic Polypeptide encoding a light chain variable (vL) fragment

SEQ ID NO: 10595 - protein, 109 aa, Artificial Sequence; identical to SEQ ID NO: 4011
  Synthetic Polypeptide encoding a light chain variable (vL) fragment

SEQ ID NO: 10596 - protein, 106 aa, Artificial Sequence; identical to SEQ ID NO: 4012
  Synthetic Polypeptide encoding a light chain variable (vL) fragment

SEQ ID NO: 10597 - protein, 104 aa, Artificial Sequence; identical to SEQ ID NO: 4013
  Synthetic Polypeptide encoding a light chain variable (vL) fragment

SEQ ID NO: 10598 - protein, 107 aa, Artificial Sequence; identical to SEQ ID NO: 4014
  Synthetic Polypeptide encoding a light chain variable (vL) fragment

SEQ ID NO: 10599 - protein, 112 aa, Artificial Sequence; identical to SEQ ID NO: 4015
  Synthetic Polypeptide encoding a light chain variable (vL) fragment

SEQ ID NO: 10600 - protein, 120 aa, Artificial Sequence; identical to SEQ ID NO: 4020
  Synthetic Polypeptide encoding a light chain variable (vL) fragment

SEQ ID NO: 10601 - protein, 106 aa, Artificial Sequence
  Synthetic Polypeptide encoding a light chain variable (vL) fragment
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEI

SEQ ID NO: 10602 - protein, 108 aa, Artificial Sequence; identical to SEQ ID NO: 4022
  Synthetic Polypeptide encoding a light chain variable (vL) fragment

SEQ ID NO: 10603 - protein, 107 aa, Artificial Sequence; identical to SEQ ID NO: 4021
  Synthetic Polypeptide encoding a light chain variable (vL) fragment

SEQ ID NO: 10604 - protein, 107 aa, Artificial Sequence; identical to SEQ ID NO: 4024
  Synthetic Polypeptide encoding a light chain variable (vL) fragment

SEQ ID NO: 10605 - protein, 113 aa, Artificial Sequence; identical to SEQ ID NO: 4031
  Synthetic Polypeptide encoding a light chain variable (vL) fragment

SEQ ID NO: 10606 - protein, 113 aa, Artificial Sequence; identical to SEQ ID NO: 4032
  Synthetic Polypeptide encoding a light chain variable (vL) fragment

SEQ ID NO: 10607 - protein, 107 aa, Artificial Sequence; identical to SEQ ID NO: 4033
  Synthetic Polypeptide encoding a light chain variable (vL) fragment

SEQ ID NO: 10608 - protein, 108 aa, Artificial Sequence; identical to SEQ ID NO: 4034
  Synthetic Polypeptide encoding a light chain variable (vL) fragment

SEQ ID NO: 10609 - protein, 111 aa, Artificial Sequence; identical to SEQ ID NO: 4035
  Synthetic Polypeptide encoding a light chain variable (vL) fragment

SEQ ID NO: 10610 - protein, 107 aa, Artificial Sequence; identical to SEQ ID NO: 4036
  Synthetic Polypeptide encoding a light chain variable (vL) fragment

SEQ ID NO: 10611 - protein, 111 aa, Artificial Sequence; identical to SEQ ID NO: 4037
  Synthetic Polypeptide encoding a light chain variable (vL) fragment

SEQ ID NO: 10612 - protein, 105 aa, Artificial Sequence; identical to SEQ ID NO: 4038
  Synthetic Polypeptide encoding a light chain variable (vL) fragment

SEQ ID NO: 10613 - protein, 112 aa, Artificial Sequence; identical to SEQ ID NO: 4039
  Synthetic Polypeptide encoding a light chain variable (vL) fragment

SEQ ID NO: 10614 - protein, 107 aa, Artificial Sequence; identical to SEQ ID NO: 4040
  Synthetic Polypeptide encoding a light chain variable (vL) fragment

SEQ ID NO: 10615 - protein, 113 aa, Artificial Sequence; identical to SEQ ID NO: 4041
  Synthetic Polypeptide encoding a light chain variable (vL) fragment

SEQ ID NO: 10616 - protein, 112 aa, Artificial Sequence; identical to SEQ ID NO: 4042
  Synthetic Polypeptide encoding a light chain variable (vL) fragment

SEQ ID NO: 10617 - protein, 107 aa, Artificial Sequence; identical to SEQ ID NO: 4045
  Synthetic Polypeptide encoding a light chain variable (vL) fragment

SEQ ID NO: 10618 - protein, 103 aa, Artificial Sequence; identical to SEQ ID NO: 4046
  Synthetic Polypeptide encoding a light chain variable (vL) fragment

SEQ ID NO: 10619 - protein, 112 aa, Artificial Sequence; identical to SEQ ID NO: 4047
  Synthetic Polypeptide encoding a light chain variable (vL) fragment

SEQ ID NO: 10620 - protein, 109 aa, Artificial Sequence; identical to SEQ ID NO: 4048
  Synthetic Polypeptide encoding a light chain variable (vL) fragment

SEQ ID NO: 10621 - protein, 113 aa, Artificial Sequence; identical to SEQ ID NO: 4049
  Synthetic Polypeptide encoding a light chain variable (vL) fragment

SEQ ID NO: 10622 - protein, 105 aa, Artificial Sequence; identical to SEQ ID NO: 4050
  Synthetic Polypeptide encoding a light chain variable (vL) fragment

SEQ ID NO: 10623 - protein, 108 aa, Artificial Sequence; identical to SEQ ID NO: 4051
  Synthetic Polypeptide encoding a light chain variable (vL) fragment

SEQ ID NO: 10624 - protein, 111 aa, Artificial Sequence; identical to SEQ ID NO: 4052
  Synthetic Polypeptide encoding a light chain variable (vL) fragment

SEQ ID NO: 10625 - protein, 111 aa, Artificial Sequence; identical to SEQ ID NO: 4052
  Synthetic Polypeptide encoding a light chain variable (vL) fragment

SEQ ID NO: 10626 - protein, 111 aa, Artificial Sequence; identical to SEQ ID NO: 4054
  Synthetic Polypeptide encoding a light chain variable (vL) fragment

SEQ ID NO: 10627 - protein, 107 aa, Artificial Sequence; identical to SEQ ID NO: 3988
  Synthetic Polypeptide encoding a light chain variable (vL) fragment

SEQ ID NO: 10628 - protein, 107 aa, Artificial Sequence; identical to SEQ ID NO: 3988
  Synthetic Polypeptide encoding a light chain variable (vL) fragment

SEQ ID NO: 10629 - protein, 112 aa, Artificial Sequence; identical to SEQ ID NO: 4057
  Synthetic Polypeptide encoding a light chain variable (vL) fragment

SEQ ID NO: 10630 - protein, 107 aa, Artificial Sequence; identical to SEQ ID NO: 4058
  Synthetic Polypeptide encoding a light chain variable (vL) fragment

SEQ ID NO: 10631 - protein, 112 aa, Artificial Sequence; identical to SEQ ID NO: 4059
  Synthetic Polypeptide encoding a light chain variable (vL) fragment

SEQ ID NO: 10632 - protein, 107 aa, Artificial Sequence; identical to SEQ ID NO: 4060
  Synthetic Polypeptide encoding a light chain variable (vL) fragment

SEQ ID NO: 10633 - protein, 111 aa, Artificial Sequence; identical to SEQ ID NO: 4061
  Synthetic Polypeptide encoding a light chain variable (vL) fragment

SEQ ID NO: 10634 - protein, 111 aa, Artificial Sequence; identical to SEQ ID NO: 4062
  Synthetic Polypeptide encoding a light chain variable (vL) fragment

SEQ ID NO: 10635 - protein, 107 aa, Artificial Sequence; identical to SEQ ID NO: 4065
  Synthetic Polypeptide encoding a light chain variable (vL) fragment

SEQ ID NO: 10636 - protein, 107 aa, Artificial Sequence; identical to SEQ ID NO: 4067
  Synthetic Polypeptide encoding a light chain variable (vL) fragment

SEQ ID NO: 10637 - protein, 105 aa, Artificial Sequence; identical to SEQ ID NO: 4066
  Synthetic Polypeptide encoding a light chain variable (vL) fragment

SEQ ID NO: 10638 - protein, 105 aa, Artificial Sequence; identical to SEQ ID NO: 4068
  Synthetic Polypeptide encoding a light chain variable (vL) fragment

SEQ ID NO: 10639 - protein, 104 aa, Artificial Sequence; identical to SEQ ID NO: 4069
  Synthetic Polypeptide encoding a light chain variable (vL) fragment

SEQ ID NO: 10640 - protein, 107 aa, Artificial Sequence; identical to SEQ ID NO: 4070
  Synthetic Polypeptide encoding a light chain variable (vL) fragment

SEQ ID NO: 10641 - protein, 108 aa, Artificial Sequence; identical to SEQ ID NO: 4072
  Synthetic Polypeptide encoding a light chain variable (vL) fragment

SEQ ID NO: 10642 - protein, 109 aa, Artificial Sequence; identical to SEQ ID NO: 4075
  Synthetic Polypeptide encoding a light chain variable (vL) fragment

SEQ ID NO: 10643 - protein, 113 aa, Artificial Sequence; identical to SEQ ID NO: 4076
  Synthetic Polypeptide encoding a light chain variable (vL) fragment

SEQ ID NO: 10644 - protein, 97 aa, Artificial Sequence; identical to SEQ ID NO: 4077
  Synthetic Polypeptide encoding a light chain variable (vL) fragment

SEQ ID NO: 10645 - protein, 109 aa, Artificial Sequence; identical to SEQ ID NO: 4078
  Synthetic Polypeptide encoding a light chain variable (vL) fragment

SEQ ID NO: 10646 - protein, 107 aa, Artificial Sequence; identical to SEQ ID NO: 4079
  Synthetic Polypeptide encoding a light chain variable (vL) fragment

SEQ ID NO: 10647 - protein, 119 aa, Artificial Sequence; identical to SEQ ID NO: 4080
  Synthetic Polypeptide encoding a light chain variable (vL) fragment

SEQ ID NO: 10648 - protein, 103 aa, Artificial Sequence; identical to SEQ ID NO: 4081
  Synthetic Polypeptide encoding a light chain variable (vL) fragment

SEQ ID NO: 10649 - protein, 106 aa, Artificial Sequence; identical to SEQ ID NO: 4082
  Synthetic Polypeptide encoding a light chain variable (vL) fragment

SEQ ID NO: 10650 - protein, 113 aa, Artificial Sequence; identical to SEQ ID NO: 4083
  Synthetic Polypeptide encoding a light chain variable (vL) fragment

SEQ ID NO: 10651 - protein, 108 aa, Artificial Sequence; identical to SEQ ID NO: 4084
  Synthetic Polypeptide encoding a light chain variable (vL) fragment

SEQ ID NO: 10652 - protein, 107 aa, Artificial Sequence; identical to SEQ ID NO: 4085
  Synthetic Polypeptide encoding a light chain variable (vL) fragment

SEQ ID NO: 10653 - protein, 107 aa, Artificial Sequence; identical to SEQ ID NO: 4086
  Synthetic Polypeptide encoding a light chain variable (vL) fragment

SEQ ID NO: 10654 - protein, 112 aa, Artificial Sequence; identical to SEQ ID NO: 4087
  Synthetic Polypeptide encoding a light chain variable (vL) fragment

SEQ ID NO: 10655 - protein, 107 aa, Artificial Sequence; identical to SEQ ID NO: 4088
  Synthetic Polypeptide encoding a light chain variable (vL) fragment

SEQ ID NO: 10656 - protein, 107 aa, Artificial Sequence; identical to SEQ ID NO: 4089
  Synthetic Polypeptide encoding a light chain variable (vL) fragment

SEQ ID NO: 10657 - protein, 116 aa, Artificial Sequence; identical to SEQ ID NO: 4090
  Synthetic Polypeptide encoding a light chain variable (vL) fragment

SEQ ID NO: 10658 - protein, 115 aa, Artificial Sequence; identical to SEQ ID NO: 4091
  Synthetic Polypeptide encoding a light chain variable (vL) fragment

SEQ ID NO: 10659 - protein, 108 aa, Artificial Sequence; identical to SEQ ID NO: 4092
  Synthetic Polypeptide encoding a light chain variable (vL) fragment

SEQ ID NO: 10660 - protein, 108 aa, Artificial Sequence; identical to SEQ ID NO: 4093
  Synthetic Polypeptide encoding a light chain variable (vL) fragment

SEQ ID NO: 10661 - protein, 107 aa, Artificial Sequence; identical to SEQ ID NO: 4094
  Synthetic Polypeptide encoding a light chain variable (vL) fragment

SEQ ID NO: 10662 - protein, 107 aa, Artificial Sequence; identical to SEQ ID NO: 4094
  Synthetic Polypeptide encoding a light chain variable (vL) fragment

SEQ ID NO: 10663 - protein, 106 aa, Artificial Sequence; identical to SEQ ID NO: 4096
  Synthetic Polypeptide encoding a light chain variable (vL) fragment

SEQ ID NO: 10664 - protein, 112 aa, Artificial Sequence; identical to SEQ ID NO: 4097
  Synthetic Polypeptide encoding a light chain variable (vL) fragment

SEQ ID NO: 10665 - protein, 112 aa, Artificial Sequence; identical to SEQ ID NO: 4098
  Synthetic Polypeptide encoding a light chain variable (vL) fragment

SEQ ID NO: 10666 - protein, 115 aa, Artificial Sequence; identical to SEQ ID NO: 4099
  Synthetic Polypeptide encoding a light chain variable (vL) fragment

SEQ ID NO: 10667 - protein, 111 aa, Artificial Sequence; identical to SEQ ID NO: 4100
  Synthetic Polypeptide encoding a light chain variable (vL) fragment

SEQ ID NO: 10668 - protein, 109 aa, Artificial Sequence; identical to SEQ ID NO: 4101
  Synthetic Polypeptide encoding a light chain variable (vL) fragment

SEQ ID NO: 10669 - protein, 108 aa, Artificial Sequence; identical to SEQ ID NO: 4102
  Synthetic Polypeptide encoding a light chain variable (vL) fragment

SEQ ID NO: 10670 - protein, 113 aa, Artificial Sequence; identical to SEQ ID NO: 4103
  Synthetic Polypeptide encoding a light chain variable (vL) fragment

SEQ ID NO: 10671 - protein, 109 aa, Artificial Sequence; identical to SEQ ID NO: 4104
  Synthetic Polypeptide encoding a light chain variable (vL) fragment

SEQ ID NO: 10672 - protein, 112 aa, Artificial Sequence; identical to SEQ ID NO: 4105
  Synthetic Polypeptide encoding a light chain variable (vL) fragment

SEQ ID NO: 10673 - protein, 109 aa, Artificial Sequence
  Synthetic Polypeptide encoding a light chain variable (vL) fragment
QSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVL

SEQ ID NO: 10674 - protein, 97 aa, Artificial Sequence; identical to SEQ ID NO: 4107
  Synthetic Polypeptide encoding a light chain variable (vL) fragment

SEQ ID NO: 10675 - protein, 107 aa, Artificial Sequence [sequence omitted]

SEQ ID NO: 10676 - protein, 107 aa, Artificial Sequence; identical to SEQ ID NO: 4109
  Synthetic Polypeptide encoding a light chain variable (vL) fragment

SEQ ID NO: 10677 - protein, 108 aa, Artificial Sequence; identical to SEQ ID NO: 4110
  Synthetic Polypeptide encoding a light chain variable (vL) fragment

SEQ ID NO: 10678 - protein, 112 aa, Artificial Sequence; identical to SEQ ID NO: 4111
  Synthetic Polypeptide encoding a light chain variable (vL) fragment

SEQ ID NO: 10679 - protein, 108 aa, Artificial Sequence; identical to SEQ ID NO: 4112
  Synthetic Polypeptide encoding a light chain variable (vL) fragment

SEQ ID NO: 10680 - protein, 106 aa, Artificial Sequence; identical to SEQ ID NO: 4113
  Synthetic Polypeptide encoding a light chain variable (vL) fragment

SEQ ID NO: 10681 - protein, 113 aa, Artificial Sequence; identical to SEQ ID NO: 4114
  Synthetic Polypeptide encoding a light chain variable (vL) fragment

SEQ ID NO: 10682 - protein, 107 aa, Artificial Sequence; identical to SEQ ID NO: 4115
  Synthetic Polypeptide encoding a light chain variable (vL) fragment

SEQ ID NO: 10683 - protein, 107 aa, Artificial Sequence; identical to SEQ ID NO: 4116
  Synthetic Polypeptide encoding a light chain variable (vL) fragment

SEQ ID NO: 10684 - protein, 103 aa, Artificial Sequence; identical to SEQ ID NO: 4117
  Synthetic Polypeptide encoding a light chain variable (vL) fragment

SEQ ID NO: 10685 - protein, 108 aa, Artificial Sequence; identical to SEQ ID NO: 4118
  Synthetic Polypeptide encoding a light chain variable (vL) fragment

SEQ ID NO: 10686 - protein, 107 aa, Artificial Sequence; identical to SEQ ID NO: 4119
  Synthetic Polypeptide encoding a light chain variable (vL) fragment

SEQ ID NO: 10687 - protein, 108 aa, Artificial Sequence; identical to SEQ ID NO: 4120
  Synthetic Polypeptide encoding a light chain variable (vL) fragment

SEQ ID NO: 10688 - protein, 107 aa, Artificial Sequence; identical to SEQ ID NO: 4121
  Synthetic Polypeptide encoding a light chain variable (vL) fragment

SEQ ID NO: 10689 - protein, 108 aa, Artificial Sequence; identical to SEQ ID NO: 4122
  Synthetic Polypeptide encoding a light chain variable (vL) fragment

SEQ ID NO: 10690 - protein, 106 aa, Artificial Sequence; identical to SEQ ID NO: 4123
  Synthetic Polypeptide encoding a light chain variable (vL) fragment

SEQ ID NO: 10691 - protein, 108 aa, Artificial Sequence; identical to SEQ ID NO: 4124
  Synthetic Polypeptide encoding a light chain variable (vL) fragment

SEQ ID NO: 10692 - protein, 113 aa, Artificial Sequence; identical to SEQ ID NO: 4125
  Synthetic Polypeptide encoding a light chain variable (vL) fragment

SEQ ID NO: 10693 - protein, 109 aa, Artificial Sequence; identical to SEQ ID NO: 4126
  Synthetic Polypeptide encoding a light chain variable (vL) fragment

SEQ ID NO: 10694 - protein, 113 aa, Artificial Sequence; identical to SEQ ID NO: 4127
  Synthetic Polypeptide encoding a light chain variable (vL) fragment

SEQ ID NO: 10695 - protein, 108 aa, Artificial Sequence; identical to SEQ ID NO: 4128
  Synthetic Polypeptide encoding a light chain variable (vL) fragment

SEQ ID NO: 10696 - protein, 109 aa, Artificial Sequence; identical to SEQ ID NO: 4129
  Synthetic Polypeptide encoding a light chain variable (vL) fragment

SEQ ID NO: 10697 - protein, 108 aa, Artificial Sequence; identical to SEQ ID NO: 4130
  Synthetic Polypeptide encoding a light chain variable (vL) fragment

SEQ ID NO: 10698 - protein, 107 aa, Artificial Sequence; identical to SEQ ID NO: 4132
  Synthetic Polypeptide encoding a light chain variable (vL) fragment

SEQ ID NO: 10699 - protein, 114 aa, Artificial Sequence; identical to SEQ ID NO: 4133
  Synthetic Polypeptide encoding a light chain variable (vL) fragment

SEQ ID NO: 10700 - protein, 107 aa, Artificial Sequence; identical to SEQ ID NO: 4134
  Synthetic Polypeptide encoding a light chain variable (vL) fragment

SEQ ID NO: 10701 - protein, 108 aa, Artificial Sequence; identical to SEQ ID NO: 4135
  Synthetic Polypeptide encoding a light chain variable (vL) fragment

SEQ ID NO: 10702 - protein, 113 aa, Artificial Sequence; identical to SEQ ID NO: 4136
  Synthetic Polypeptide encoding a light chain variable (vL) fragment

SEQ ID NO: 10703 - protein, 107 aa, Artificial Sequence; identical to SEQ ID NO: 4137
  Synthetic Polypeptide encoding a light chain variable (vL) fragment

SEQ ID NO: 10704 - protein, 111 aa, Artificial Sequence; identical to SEQ ID NO: 4138
  Synthetic Polypeptide encoding a light chain variable (vL) fragment

SEQ ID NO: 10705 - protein, 109 aa, Artificial Sequence; identical to SEQ ID NO: 4139
  Synthetic Polypeptide encoding a light chain variable (vL) fragment

SEQ ID NO: 10706 - protein, 107 aa, Artificial Sequence; identical to SEQ ID NO: 4140
  Synthetic Polypeptide encoding a light chain variable (vL) fragment

SEQ ID NO: 10707 - protein, 107 aa, Artificial Sequence; identical to SEQ ID NO: 4141
  Synthetic Polypeptide encoding a light chain variable (vL) fragment

SEQ ID NO: 10708 - protein, 108 aa, Artificial Sequence; identical to SEQ ID NO: 4142
  Synthetic Polypeptide encoding a light chain variable (vL) fragment

SEQ ID NO: 10709 - protein, 113 aa, Artificial Sequence; identical to SEQ ID NO: 4143
  Synthetic Polypeptide encoding a light chain variable (vL) fragment

SEQ ID NO: 10710 - protein, 113 aa, Artificial Sequence; identical to SEQ ID NO: 4144
  Synthetic Polypeptide encoding a light chain variable (vL) fragment

SEQ ID NO: 10711 - protein, 113 aa, Artificial Sequence; identical to SEQ ID NO: 4145
  Synthetic Polypeptide encoding a light chain variable (vL) fragment

SEQ ID NO: 10712 - protein, 107 aa, Artificial Sequence; identical to SEQ ID NO: 4146
  Synthetic Polypeptide encoding a light chain variable (vL) fragment

SEQ ID NO: 10713 - protein, 110 aa, Artificial Sequence; identical to SEQ ID NO: 4147
  Synthetic Polypeptide encoding a light chain variable (vL) fragment

SEQ ID NO: 10714 - protein, 107 aa, Artificial Sequence; identical to SEQ ID NO: 4148
  Synthetic Polypeptide encoding a light chain variable (vL) fragment

SEQ ID NO: 10715 - protein, 111 aa, Artificial Sequence; identical to SEQ ID NO: 4149
  Synthetic Polypeptide encoding a light chain variable (vL) fragment

SEQ ID NO: 10716 - protein, 109 aa, Artificial Sequence; identical to SEQ ID NO: 4150
  Synthetic Polypeptide encoding a light chain variable (vL) fragment

SEQ ID NO: 10717 - protein, 109 aa, Artificial Sequence; identical to SEQ ID NO: 4151
  Synthetic Polypeptide encoding a light chain variable (vL) fragment

SEQ ID NO: 10718 - protein, 111 aa, Artificial Sequence; identical to SEQ ID NO: 3939
  Synthetic Polypeptide encoding a light chain variable (vL) fragment

SEQ ID NO: 10719 - protein, 108 aa, Artificial Sequence; identical to SEQ ID NO: 4152
  Synthetic Polypeptide encoding a light chain variable (vL) fragment

SEQ ID NO: 10720 - protein, 108 aa, Artificial Sequence; identical to SEQ ID NO: 4153
  Synthetic Polypeptide encoding a light chain variable (vL) fragment

SEQ ID NO: 10721 - protein, 107 aa, Artificial Sequence; identical to SEQ ID NO: 4154
  Synthetic Polypeptide encoding a light chain variable (vL) fragment

SEQ ID NO: 10722 - protein, 106 aa, Artificial Sequence; identical to SEQ ID NO: 4155
  Synthetic Polypeptide encoding a light chain variable (vL) fragment

SEQ ID NO: 10723 - protein, 106 aa, Artificial Sequence; identical to SEQ ID NO: 4156
  Synthetic Polypeptide encoding a light chain variable (vL) fragment

SEQ ID NO: 10724 - protein, 108 aa, Artificial Sequence; identical to SEQ ID NO: 4157
  Synthetic Polypeptide encoding a light chain variable (vL) fragment

SEQ ID NO: 10725 - protein, 112 aa, Artificial Sequence; identical to SEQ ID NO: 4158
  Synthetic Polypeptide encoding a light chain variable (vL) fragment

SEQ ID NO: 10726 - protein, 107 aa, Artificial Sequence; identical to SEQ ID NO: 4159
  Synthetic Polypeptide encoding a light chain variable (vL) fragment

SEQ ID NO: 10727 - protein, 107 aa, Artificial Sequence; identical to SEQ ID NO: 4160
  Synthetic Polypeptide encoding a light chain variable (vL) fragment

SEQ ID NO: 10728 - protein, 107 aa, Artificial Sequence; identical to SEQ ID NO: 4161
  Synthetic Polypeptide encoding a light chain variable (vL) fragment

SEQ ID NO: 10729 - protein, 108 aa, Artificial Sequence; identical to SEQ ID NO: 4162
  Synthetic Polypeptide encoding a light chain variable (vL) fragment

SEQ ID NO: 10730 - protein, 111 aa, Artificial Sequence; identical to SEQ ID NO: 3924
  Synthetic Polypeptide encoding a light chain variable (vL) fragment

SEQ ID NO: 10731 - protein, 110 aa, Artificial Sequence; identical to SEQ ID NO: 3925
  Synthetic Polypeptide encoding a light chain variable (vL) fragment

SEQ ID NO: 10732 - protein, 113 aa, Artificial Sequence; identical to SEQ ID NO: 3926
  Synthetic Polypeptide encoding a light chain variable (vL) fragment

SEQ ID NO: 10733 - protein, 114 aa, Artificial Sequence; identical to SEQ ID NO: 3934
  Synthetic Polypeptide encoding a light chain variable (vL) fragment

SEQ ID NO: 10734 - protein, 111 aa, Artificial Sequence; identical to SEQ ID NO: 3935
  Synthetic Polypeptide encoding a light chain variable (vL) fragment

SEQ ID NO: 10735 - protein, 112 aa, Artificial Sequence; identical to SEQ ID NO: 3936
  Synthetic Polypeptide encoding a light chain variable (vL) fragment

SEQ ID NO: 10736 - protein, 113 aa, Artificial Sequence; identical to SEQ ID NO: 3940
  Synthetic Polypeptide encoding a light chain variable (vL) fragment

SEQ ID NO: 10737 - protein, 113 aa, Artificial Sequence; identical to SEQ ID NO: 3940
  Synthetic Polypeptide encoding a light chain variable (vL) fragment

SEQ ID NO: 10738 - protein, 109 aa, Artificial Sequence; identical to SEQ ID NO: 3942
  Synthetic Polypeptide encoding a light chain variable (vL) fragment

SEQ ID NO: 10739 - protein, 111 aa, Artificial Sequence; identical to SEQ ID NO: 3943
  Synthetic Polypeptide encoding a light chain variable (vL) fragment

SEQ ID NO: 10740 - protein, 107 aa, Artificial Sequence; identical to SEQ ID NO: 3944
  Synthetic Polypeptide encoding a light chain variable (vL) fragment

SEQ ID NO: 10741 - protein, 108 aa, Artificial Sequence; identical to SEQ ID NO: 3945
  Synthetic Polypeptide encoding a light chain variable (vL) fragment

SEQ ID NO: 10742 - protein, 108 aa, Artificial Sequence; identical to SEQ ID NO: 3946
  Synthetic Polypeptide encoding a light chain variable (vL) fragment

SEQ ID NO: 10743 - protein, 107 aa, Artificial Sequence; identical to SEQ ID NO: 3947
  Synthetic Polypeptide encoding a light chain variable (vL) fragment

SEQ ID NO: 10744 - protein, 106 aa, Artificial Sequence; identical to SEQ ID NO: 3948
  Synthetic Polypeptide encoding a light chain variable (vL) fragment

SEQ ID NO: 10745 - protein, 113 aa, Artificial Sequence; identical to SEQ ID NO: 3949
  Synthetic Polypeptide encoding a light chain variable (vL) fragment

SEQ ID NO: 10746 - protein, 113 aa, Artificial Sequence; identical to SEQ ID NO: 3950
  Synthetic Polypeptide encoding a light chain variable (vL) fragment

SEQ ID NO: 10747 - protein, 111 aa, Artificial Sequence; identical to SEQ ID NO: 3960
  Synthetic Polypeptide encoding a light chain variable (vL) fragment

SEQ ID NO: 10748 - protein, 107 aa, Artificial Sequence; identical to SEQ ID NO: 3961
  Synthetic Polypeptide encoding a light chain variable (vL) fragment

SEQ ID NO: 10749 - protein, 112 aa, Artificial Sequence; identical to SEQ ID NO: 3962
  Synthetic Polypeptide encoding a light chain variable (vL) fragment

SEQ ID NO: 10750 - protein, 111 aa, Artificial Sequence; identical to SEQ ID NO: 3963
  Synthetic Polypeptide encoding a light chain variable (vL) fragment

SEQ ID NO: 10751 - protein, 111 aa, Artificial Sequence; identical to SEQ ID NO: 3964
  Synthetic Polypeptide encoding a light chain variable (vL) fragment

SEQ ID NO: 10752 - protein, 109 aa, Artificial Sequence; identical to SEQ ID NO: 3965
  Synthetic Polypeptide encoding a light chain variable (vL) fragment

SEQ ID NO: 10753 - protein, 104 aa, Artificial Sequence; identical to SEQ ID NO: 3966
  Synthetic Polypeptide encoding a light chain variable (vL) fragment

SEQ ID NO: 10754 - protein, 108 aa, Artificial Sequence; identical to SEQ ID NO: 3967
  Synthetic Polypeptide encoding a light chain variable (vL) fragment

SEQ ID NO: 10755 - protein, 112 aa, Artificial Sequence; identical to SEQ ID NO: 3968
  Synthetic Polypeptide encoding a light chain variable (vL) fragment

SEQ ID NO: 10756 - protein, 107 aa, Artificial Sequence; identical to SEQ ID NO: 3971
  Synthetic Polypeptide encoding a light chain variable (vL) fragment

SEQ ID NO: 10757 - protein, 107 aa, Artificial Sequence; identical to SEQ ID NO: 3972
  Synthetic Polypeptide encoding a light chain variable (vL) fragment

SEQ ID NO: 10758 - protein, 107 aa, Artificial Sequence; identical to SEQ ID NO: 3973
  Synthetic Polypeptide encoding a light chain variable (vL) fragment

SEQ ID NO: 10759 - protein, 107 aa, Artificial Sequence; identical to SEQ ID NO: 3974
  Synthetic Polypeptide encoding a light chain variable (vL) fragment

SEQ ID NO: 10760 - protein, 106 aa, Artificial Sequence; identical to SEQ ID NO: 3975
  Synthetic Polypeptide encoding a light chain variable (vL) fragment

SEQ ID NO: 10761 - protein, 111 aa, Artificial Sequence; identical to SEQ ID NO: 3976
  Synthetic Polypeptide encoding a light chain variable (vL) fragment

SEQ ID NO: 10762 - protein, 111 aa, Artificial Sequence; identical to SEQ ID NO: 3977
  Synthetic Polypeptide encoding a light chain variable (vL) fragment

SEQ ID NO: 10763 - protein, 106 aa, Artificial Sequence; identical to SEQ ID NO: 3979
  Synthetic Polypeptide encoding a light chain variable (vL) fragment

SEQ ID NO: 10764 - protein, 107 aa, Artificial Sequence; identical to SEQ ID NO: 3969
  Synthetic Polypeptide encoding a light chain variable (vL) fragment

SEQ ID NO: 10765 - protein, 107 aa, Artificial Sequence; identical to SEQ ID NO: 3981
  Synthetic Polypeptide encoding a light chain variable (vL) fragment

SEQ ID NO: 10766 - protein, 111 aa, Artificial Sequence; identical to SEQ ID NO: 3993
  Synthetic Polypeptide encoding a light chain variable (vL) fragment

SEQ ID NO: 10767 - protein, 107 aa, Artificial Sequence; identical to SEQ ID NO: 3994
  Synthetic Polypeptide encoding a light chain variable (vL) fragment

SEQ ID NO: 10768 - protein, 107 aa, Artificial Sequence; identical to SEQ ID NO: 3995
  Synthetic Polypeptide encoding a light chain variable (vL) fragment

SEQ ID NO: 10769 - protein, 112 aa, Artificial Sequence; identical to SEQ ID NO: 3996
  Synthetic Polypeptide encoding a light chain variable (vL) fragment

SEQ ID NO: 10770 - protein, 111 aa, Artificial Sequence; identical to SEQ ID NO: 3997
  Synthetic Polypeptide encoding a light chain variable (vL) fragment

SEQ ID NO: 10771 - protein, 107 aa, Artificial Sequence; identical to SEQ ID NO: 3998
  Synthetic Polypeptide encoding a light chain variable (vL) fragment

SEQ ID NO: 10772 - protein, 112 aa, Artificial Sequence; identical to SEQ ID NO: 4007
  Synthetic Polypeptide encoding a light chain variable (vL) fragment

SEQ ID NO: 10773 - protein, 106 aa, Artificial Sequence; identical to SEQ ID NO: 4016
  Synthetic Polypeptide encoding a light chain variable (vL) fragment

SEQ ID NO: 10774 - protein, 111 aa, Artificial Sequence; identical to SEQ ID NO: 4017
  Synthetic Polypeptide encoding a light chain variable (vL) fragment

SEQ ID NO: 10775 - protein, 108 aa, Artificial Sequence; identical to SEQ ID NO: 4018
  Synthetic Polypeptide encoding a light chain variable (vL) fragment

SEQ ID NO: 10776 - protein, 108 aa, Artificial Sequence; identical to SEQ ID NO: 4019
  Synthetic Polypeptide encoding a light chain variable (vL) fragment

SEQ ID NO: 10777 - protein, 109 aa, Artificial Sequence; identical to SEQ ID NO: 4025
  Synthetic Polypeptide encoding a light chain variable (vL) fragment

SEQ ID NO: 10778 - protein, 113 aa, Artificial Sequence; identical to SEQ ID NO: 4026
  Synthetic Polypeptide encoding a light chain variable (vL) fragment

SEQ ID NO: 10779 - protein, 113 aa, Artificial Sequence; identical to SEQ ID NO: 4027
  Synthetic Polypeptide encoding a light chain variable (vL) fragment

SEQ ID NO: 10780 - protein, 113 aa, Artificial Sequence; identical to SEQ ID NO: 4028
  Synthetic Polypeptide encoding a light chain variable (vL) fragment

SEQ ID NO: 10781 - protein, 107 aa, Artificial Sequence; identical to SEQ ID NO: 4029
  Synthetic Polypeptide encoding a light chain variable (vL) fragment

SEQ ID NO: 10782 - protein, 108 aa, Artificial Sequence; identical to SEQ ID NO: 4030
  Synthetic Polypeptide encoding a light chain variable (vL) fragment

SEQ ID NO: 10783 - protein, 112 aa, Artificial Sequence; identical to SEQ ID NO: 4043
  Synthetic Polypeptide encoding a light chain variable (vL) fragment

SEQ ID NO: 10784 - protein, 110 aa, Artificial Sequence [sequence omitted]

SEQ ID NO: 10785 - protein, 113 aa, Artificial Sequence; identical to SEQ ID NO: 4063
  Synthetic Polypeptide encoding a light chain variable (vL) fragment

SEQ ID NO: 10786 - protein, 111 aa, Artificial Sequence; identical to SEQ ID NO: 4064
  Synthetic Polypeptide encoding a light chain variable (vL) fragment

SEQ ID NO: 10787 - protein, 108 aa, Artificial Sequence; identical to SEQ ID NO: 4071
  Synthetic Polypeptide encoding a light chain variable (vL) fragment

SEQ ID NO: 10788 - protein, 113 aa, Artificial Sequence; identical to SEQ ID NO: 4073
  Synthetic Polypeptide encoding a light chain variable (vL) fragment

SEQ ID NO: 10789 - protein, 110 aa, Artificial Sequence; identical to SEQ ID NO: 4074
  Synthetic Polypeptide encoding a light chain variable (vL) fragment

SEQ ID NO: 10790 - protein, 107 aa, Artificial Sequence; identical to SEQ ID NO: 4109
  Synthetic Polypeptide encoding a light chain variable (vL) fragment

SEQ ID NO: 10791 - protein, 113 aa, Artificial Sequence; identical to SEQ ID NO: 4163
  Synthetic Polypeptide encoding a light chain variable (vL) fragment

SEQ ID NO: 10792 - protein, 124 aa, Artificial Sequence; identical to SEQ ID NO: 4164
  Synthetic Polypeptide encoding a light chain variable (vL) fragment

SEQ ID NO: 10793 - protein, 108 aa, Artificial Sequence; identical to SEQ ID NO: 4165
  Synthetic Polypeptide encoding a light chain variable (vL) fragment

SEQ ID NO: 10794 - protein, 107 aa, Artificial Sequence; identical to SEQ ID NO: 4109
  Synthetic Polypeptide encoding a light chain variable (vL) fragment

SEQ ID NO: 10795 - protein, 108 aa, Artificial Sequence; identical to SEQ ID NO: 4167
  Synthetic Polypeptide encoding a light chain variable (vL) fragment

SEQ ID NO: 10796 - protein, 111 aa, Artificial Sequence; identical to SEQ ID NO: 4168
  Synthetic Polypeptide encoding a light chain variable (vL) fragment

SEQ ID NO: 10797 - protein, 112 aa, Artificial Sequence; identical to SEQ ID NO: 4169
  Synthetic Polypeptide encoding a light chain variable (vL) fragment

SEQ ID NO: 10798 - protein, 106 aa, Artificial Sequence; identical to SEQ ID NO: 4170
  Synthetic Polypeptide encoding a light chain variable (vL) fragment

SEQ ID NO: 10799 - protein, 113 aa, Artificial Sequence; identical to SEQ ID NO: 4171
  Synthetic Polypeptide encoding a light chain variable (vL) fragment

SEQ ID NO: 10800 - protein, 107 aa, Artificial Sequence; identical to SEQ ID NO: 4172
  Synthetic Polypeptide encoding a light chain variable (vL) fragment

SEQ ID NO: 10801 - protein, 113 aa, Artificial Sequence; identical to SEQ ID NO: 4173
  Synthetic Polypeptide encoding a light chain variable (vL) fragment

SEQ ID NO: 10802 - protein, 111 aa, Artificial Sequence; identical to SEQ ID NO: 4174
  Synthetic Polypeptide encoding a light chain variable (vL) fragment

SEQ ID NO: 10803 - protein, 112 aa, Artificial Sequence; identical to SEQ ID NO: 4175
  Synthetic Polypeptide encoding a light chain variable (vL) fragment

SEQ ID NO: 10804 - protein, 111 aa, Artificial Sequence; identical to SEQ ID NO: 4176
  Synthetic Polypeptide encoding a light chain variable (vL) fragment

SEQ ID NO: 10805 - protein, 112 aa, Artificial Sequence; identical to SEQ ID NO: 3936
  Synthetic Polypeptide encoding a light chain variable (vL) fragment

SEQ ID NO: 10806 - protein, 112 aa, Artificial Sequence; identical to SEQ ID NO: 3932
  Synthetic Polypeptide encoding a light chain variable (vL) fragment

SEQ ID NO: 10807 - protein, 107 aa, Artificial Sequence; identical to SEQ ID NO: 4179
  Synthetic Polypeptide encoding a light chain variable (vL) fragment

SEQ ID NO: 10808 - protein, 113 aa, Artificial Sequence; identical to SEQ ID NO: 4180
  Synthetic Polypeptide encoding a light chain variable (vL) fragment

SEQ ID NO: 10809 - protein, 106 aa, Artificial Sequence; identical to SEQ ID NO: 4181
  Synthetic Polypeptide encoding a light chain variable (vL) fragment

SEQ ID NO: 10810 - protein, 112 aa, Artificial Sequence; identical to SEQ ID NO: 4182
  Synthetic Polypeptide encoding a light chain variable (vL) fragment

SEQ ID NO: 10811 - protein, 110 aa, Artificial Sequence; identical to SEQ ID NO: 4183
  Synthetic Polypeptide encoding a light chain variable (vL) fragment

SEQ ID NO: 10812 - protein, 112 aa, Artificial Sequence; identical to SEQ ID NO: 4184
  Synthetic Polypeptide encoding a light chain variable (vL) fragment

SEQ ID NO: 10813 - protein, 111 aa, Artificial Sequence; identical to SEQ ID NO: 4468
  Synthetic Polypeptide encoding a light chain variable (vL) fragment

SEQ ID NO: 10814 - protein, 107 aa, Artificial Sequence; identical to SEQ ID NO: 4186
  Synthetic Polypeptide encoding a light chain variable (vL) fragment

SEQ ID NO: 10815 - protein, 109 aa, Artificial Sequence; identical to SEQ ID NO: 4187
  Synthetic Polypeptide encoding a light chain variable (vL) fragment

SEQ ID NO: 10816 - protein, 107 aa, Artificial Sequence; identical to SEQ ID NO: 4188
  Synthetic Polypeptide encoding a light chain variable (vL) fragment

SEQ ID NO: 10817 - protein, 108 aa, Artificial Sequence; identical to SEQ ID NO: 4189
  Synthetic Polypeptide encoding a light chain variable (vL) fragment

SEQ ID NO: 10818 - protein, 108 aa, Artificial Sequence; identical to SEQ ID NO: 4190
  Synthetic Polypeptide encoding a light chain variable (vL) fragment

SEQ ID NO: 10819 - protein, 107 aa, Artificial Sequence
  Synthetic Polypeptide encoding a light chain variable (vL) fragment
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIK

SEQ ID NO: 10820 - protein, 108 aa, Artificial Sequence
  Synthetic Polypeptide encoding a light chain variable (vL) fragment
DIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKR

SEQ ID NO: 10821 - protein, 108 aa, Artificial Sequence
  Synthetic Polypeptide encoding a light chain variable (vL) fragment
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIK

SEQ ID NO: 10822 - protein, 108 aa, Artificial Sequence
  Synthetic Polypeptide encoding a light chain variable (vL) fragment
EIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 10823 - protein, 108 aa, Artificial Sequence
  Synthetic Polypeptide encoding a light chain variable (vL) fragment
EIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 10824 - protein, 108 aa, Artificial Sequence
  Synthetic Polypeptide encoding a light chain variable (vL) fragment
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIK

SEQ ID NO: 10825 - protein, 110 aa, Artificial Sequence
  Synthetic Polypeptide encoding a light chain variable (vL) fragment
EIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTV

SEQ ID NO: 10826 - protein, 107 aa, Artificial Sequence
  Synthetic Polypeptide encoding a light chain variable (vL) fragment
EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 10827 - protein, 107 aa, Artificial Sequence
  Synthetic Polypeptide encoding a light chain variable (vL) fragment
AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 10828 - protein, 108 aa, Artificial Sequence
  Synthetic Polypeptide encoding a light chain variable (vL) fragment
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIK

SEQ ID NO: 10829 - protein, 108 aa, Artificial Sequence
  Synthetic Polypeptide encoding a light chain variable (vL) fragment
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIK

SEQ ID NO: 10830 - protein, 100 aa, Artificial Sequence
  Synthetic Polypeptide encoding a light chain variable (vL) fragment
QSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLG

SEQ ID NO: 10831 - protein, 100 aa, Artificial Sequence
  Synthetic Polypeptide encoding a light chain variable (vL) fragment
QSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLG

SEQ ID NO: 10832 - protein, 100 aa, Artificial Sequence
  Synthetic Polypeptide encoding a light chain variable (vL) fragment
QCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLR

SEQ ID NO: 10833 - protein, 100 aa, Artificial Sequence
  Synthetic Polypeptide encoding a light chain variable (vL) fragment
YVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVR

SEQ ID NO: 10834 - protein, 100 aa, Artificial Sequence; identical to SEQ ID NO: 10833
  Synthetic Polypeptide encoding a light chain variable (vL) fragment

SEQ ID NO: 10835 - protein, 101 aa, Artificial Sequence
  Synthetic Polypeptide encoding a light chain variable (vL) fragment
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLS

SEQ ID NO: 10836 - protein, 100 aa, Artificial Sequence
  Synthetic Polypeptide encoding a light chain variable (vL) fragment
YIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMK

SEQ ID NO: 10837 - protein, 100 aa, Artificial Sequence; identical to SEQ ID NO: 10836
  Synthetic Polypeptide encoding a light chain variable (vL) fragment

SEQ ID NO: 10838 - protein, 108 aa, Artificial Sequence
  Synthetic Polypeptide encoding a light chain variable (vL) fragment
ENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIK

SEQ ID NO: 10839 - protein, 108 aa, Artificial Sequence
  Synthetic Polypeptide encoding a light chain variable (vL) fragment
ENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIK

SEQ ID NO: 10840 - protein, 107 aa, Artificial Sequence
  Synthetic Polypeptide encoding a light chain variable (vL) fragment
EIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIK

SEQ ID NO: 10841 - protein, 107 aa, Artificial Sequence
  Synthetic Polypeptide encoding a light chain variable (vL) fragment
EILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLK

SEQ ID NO: 10842 - protein, 108 aa, Artificial Sequence
  Synthetic Polypeptide encoding a light chain variable (vL) fragment
EIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIK

SEQ ID NO: 10843 - protein, 108 aa, Artificial Sequence
  Synthetic Polypeptide encoding a light chain variable (vL) fragment
EIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIK

SEQ ID NO: 10844 - protein, 108 aa, Artificial Sequence
  Synthetic Polypeptide encoding a light chain variable (vL) fragment
EIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIK

SEQ ID NO: 10845 - protein, 108 aa, Artificial Sequence
  Synthetic Polypeptide encoding a light chain variable (vL) fragment
EIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIK

SEQ ID NO: 10846 - protein, 109 aa, Artificial Sequence
  Synthetic Polypeptide encoding a light chain variable (vL) fragment
EIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIK

SEQ ID NO: 10847 - protein, 110 aa, Artificial Sequence
  Synthetic Polypeptide encoding a light chain variable (vL) fragment
SFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVL

SEQ ID NO: 10848 - protein, 110 aa, Artificial Sequence
  Synthetic Polypeptide encoding a light chain variable (vL) fragment
SFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVL

SEQ ID NO: 10849 - protein, 107 aa, Artificial Sequence; identical to SEQ ID NO: 4088
  Synthetic Polypeptide encoding a light chain variable (vL) fragment

SEQ ID NO: 10850 - protein, 107 aa, Artificial Sequence; identical to SEQ ID NO: 4089
  Synthetic Polypeptide encoding a light chain variable (vL) fragment

SEQ ID NO: 10851 - protein, 112 aa, Artificial Sequence
  Synthetic Polypeptide encoding a light chain variable (vL) fragment
DIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKR

SEQ ID NO: 10852 - protein, 112 aa, Artificial Sequence
  Synthetic Polypeptide encoding a light chain variable (vL) fragment
DIVLTQSPASLAVSLGERATINCRASESVSVIGAHLIHWYQQKPGQPPKLLIYLASNLETGVPARFSGSGSRTDFTLTISSVEPEDFAVYYCLQSRTIPRTFGQGTKLEIKR

SEQ ID NO: 10853 - protein, 112 aa, Artificial Sequence
  Synthetic Polypeptide encoding a light chain variable (vL) fragment
DIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKR

SEQ ID NO: 10854 - protein, 111 aa, Artificial Sequence
  Synthetic Polypeptide encoding a light chain variable (vL) fragment
DIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIK

SEQ ID NO: 10855 - protein, 111 aa, Artificial Sequence
  Synthetic Polypeptide encoding a light chain variable (vL) fragment
DIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIK

SEQ ID NO: 10856 - protein, 111 aa, Artificial Sequence
  Synthetic Polypeptide encoding a light chain variable (vL) fragment
DIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIK

SEQ ID NO: 10857 - protein, 111 aa, Artificial Sequence
  Synthetic Polypeptide encoding a light chain variable (vL) fragment
DIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIK

SEQ ID NO: 10858 - protein, 107 aa, Artificial Sequence; identical to SEQ ID NO: 4172
  Synthetic Polypeptide encoding a light chain variable (vL) fragment

SEQ ID NO: 10859 - protein, 120 aa, Artificial Sequence
  Synthetic Polypeptide encoding a heavy chain variable (vH) fragment
QVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSS

SEQ ID NO: 10860 - protein, 120 aa, Artificial Sequence; identical to SEQ ID NO: 4211
  Synthetic Polypeptide encoding a heavy chain variable (vH) fragment

SEQ ID NO: 10861 - protein, 123 aa, Artificial Sequence; identical to SEQ ID NO: 4212
  Synthetic Polypeptide encoding a heavy chain variable (vH) fragment

SEQ ID NO: 10862 - protein, 118 aa, Artificial Sequence; identical to SEQ ID NO: 4213
  Synthetic Polypeptide encoding a heavy chain variable (vH) fragment

SEQ ID NO: 10863 - protein, 117 aa, Artificial Sequence; identical to SEQ ID NO: 4214
  Synthetic Polypeptide encoding a heavy chain variable (vH) fragment

SEQ ID NO: 10864 - protein, 117 aa, Artificial Sequence; identical to SEQ ID NO: 4215
  Synthetic Polypeptide encoding a heavy chain variable (vH) fragment

SEQ ID NO: 10865 - protein, 121 aa, Artificial Sequence; identical to SEQ ID NO: 4216
  Synthetic Polypeptide encoding a heavy chain variable (vH) fragment

SEQ ID NO: 10866 - protein, 118 aa, Artificial Sequence; identical to SEQ ID NO: 4220
  Synthetic Polypeptide encoding a heavy chain variable (vH) fragment

SEQ ID NO: 10867 - protein, 120 aa, Artificial Sequence [sequence omitted]

SEQ ID NO: 10868 - protein, 122 aa, Artificial Sequence; identical to SEQ ID NO: 4234
  Synthetic Polypeptide encoding a heavy chain variable (vH) fragment

SEQ ID NO: 10869 - protein, 118 aa, Artificial Sequence; identical to SEQ ID NO: 4235
  Synthetic Polypeptide encoding a heavy chain variable (vH) fragment

SEQ ID NO: 10870 - protein, 121 aa, Artificial Sequence; identical to SEQ ID NO: 4236
  Synthetic Polypeptide encoding a heavy chain variable (vH) fragment

SEQ ID NO: 10871 - protein, 120 aa, Artificial Sequence; identical to SEQ ID NO: 4237
  Synthetic Polypeptide encoding a heavy chain variable (vH) fragment

SEQ ID NO: 10872 - protein, 120 aa, Artificial Sequence; identical to SEQ ID NO: 4237
  Synthetic Polypeptide encoding a heavy chain variable (vH) fragment

SEQ ID NO: 10873 - protein, 124 aa, Artificial Sequence; identical to SEQ ID NO: 4239
  Synthetic Polypeptide encoding a heavy chain variable (vH) fragment

SEQ ID NO: 10874 - protein, 120 aa, Artificial Sequence; identical to SEQ ID NO: 4240
  Synthetic Polypeptide encoding a heavy chain variable (vH) fragment

SEQ ID NO: 10875 - protein, 119 aa, Artificial Sequence; identical to SEQ ID NO: 4241
  Synthetic Polypeptide encoding a heavy chain variable (vH) fragment

SEQ ID NO: 10876 - protein, 120 aa, Artificial Sequence; identical to SEQ ID NO: 4242
  Synthetic Polypeptide encoding a heavy chain variable (vH) fragment

SEQ ID NO: 10877 - protein, 122 aa, Artificial Sequence; identical to SEQ ID NO: 4252
  Synthetic Polypeptide encoding a heavy chain variable (vH) fragment

SEQ ID NO: 10878 - protein, 119 aa, Artificial Sequence; identical to SEQ ID NO: 4253
  Synthetic Polypeptide encoding a heavy chain variable (vH) fragment

SEQ ID NO: 10879 - protein, 120 aa, Artificial Sequence; identical to SEQ ID NO: 4265
  Synthetic Polypeptide encoding a heavy chain variable (vH) fragment

SEQ ID NO: 10880 - protein, 117 aa, Artificial Sequence; identical to SEQ ID NO: 4266
  Synthetic Polypeptide encoding a heavy chain variable (vH) fragment

SEQ ID NO: 10881 - protein, 124 aa, Artificial Sequence; identical to SEQ ID NO: 4267
  Synthetic Polypeptide encoding a heavy chain variable (vH) fragment

SEQ ID NO: 10882 - protein, 117 aa, Artificial Sequence; identical to SEQ ID NO: 4268
  Synthetic Polypeptide encoding a heavy chain variable (vH) fragment

SEQ ID NO: 10883 - protein, 112 aa, Artificial Sequence; identical to SEQ ID NO: 4269
  Synthetic Polypeptide encoding a heavy chain variable (vH) fragment

SEQ ID NO: 10884 - protein, 117 aa, Artificial Sequence; identical to SEQ ID NO: 4270
  Synthetic Polypeptide encoding a heavy chain variable (vH) fragment

SEQ ID NO: 10885 - protein, 119 aa, Artificial Sequence; identical to SEQ ID NO: 4271
  Synthetic Polypeptide encoding a heavy chain variable (vH) fragment

SEQ ID NO: 10886 - protein, 120 aa, Artificial Sequence; identical to SEQ ID NO: 4272
  Synthetic Polypeptide encoding a heavy chain variable (vH) fragment

SEQ ID NO: 10887 - protein, 116 aa, Artificial Sequence; identical to SEQ ID NO: 4273
  Synthetic Polypeptide encoding a heavy chain variable (vH) fragment

SEQ ID NO: 10888 - protein, 118 aa, Artificial Sequence; identical to SEQ ID NO: 4274
  Synthetic Polypeptide encoding a heavy chain variable (vH) fragment

SEQ ID NO: 10889 - protein, 122 aa, Artificial Sequence; identical to SEQ ID NO: 4275
  Synthetic Polypeptide encoding a heavy chain variable (vH) fragment

SEQ ID NO: 10890 - protein, 122 aa, Artificial Sequence; identical to SEQ ID NO: 4283
  Synthetic Polypeptide encoding a heavy chain variable (vH) fragment

SEQ ID NO: 10891 - protein, 114 aa, Artificial Sequence; identical to SEQ ID NO: 4284
  Synthetic Polypeptide encoding a heavy chain variable (vH) fragment

SEQ ID NO: 10892 - protein, 121 aa, Artificial Sequence; identical to SEQ ID NO: 4285
  Synthetic Polypeptide encoding a heavy chain variable (vH) fragment

SEQ ID NO: 10893 - protein, 121 aa, Artificial Sequence; identical to SEQ ID NO: 4285
  Synthetic Polypeptide encoding a heavy chain variable (vH) fragment

SEQ ID NO: 10894 - protein, 118 aa, Artificial Sequence; identical to SEQ ID NO: 4287
  Synthetic Polypeptide encoding a heavy chain variable (vH) fragment

SEQ ID NO: 10895 - protein, 113 aa, Artificial Sequence; identical to SEQ ID NO: 4288
  Synthetic Polypeptide encoding a heavy chain variable (vH) fragment

SEQ ID NO: 10896 - protein, 117 aa, Artificial Sequence [sequence omitted]

SEQ ID NO: 10897 - protein, 123 aa, Artificial Sequence; identical to SEQ ID NO: 4291
  Synthetic Polypeptide encoding a heavy chain variable (vH) fragment

SEQ ID NO: 10898 - protein, 125 aa, Artificial Sequence; identical to SEQ ID NO: 4292
  Synthetic Polypeptide encoding a heavy chain variable (vH) fragment

SEQ ID NO: 10899 - protein, 116 aa, Artificial Sequence; identical to SEQ ID NO: 4293
  Synthetic Polypeptide encoding a heavy chain variable (vH) fragment

SEQ ID NO: 10900 - protein, 118 aa, Artificial Sequence; identical to SEQ ID NO: 4294
  Synthetic Polypeptide encoding a heavy chain variable (vH) fragment

SEQ ID NO: 10901 - protein, 118 aa, Artificial Sequence; identical to SEQ ID NO: 4295
  Synthetic Polypeptide encoding a heavy chain variable (vH) fragment

SEQ ID NO: 10902 - protein, 115 aa, Artificial Sequence; identical to SEQ ID NO: 4296
  Synthetic Polypeptide encoding a heavy chain variable (vH) fragment

SEQ ID NO: 10903 - protein, 120 aa, Artificial Sequence; identical to SEQ ID NO: 4297
  Synthetic Polypeptide encoding a heavy chain variable (vH) fragment

SEQ ID NO: 10904 - protein, 120 aa, Artificial Sequence; identical to SEQ ID NO: 4298
  Synthetic Polypeptide encoding a heavy chain variable (vH) fragment

SEQ ID NO: 10905 - protein, 122 aa, Artificial Sequence; identical to SEQ ID NO: 4303
  Synthetic Polypeptide encoding a heavy chain variable (vH) fragment

SEQ ID NO: 10906 - protein, 122 aa, Artificial Sequence; identical to SEQ ID NO: 4304
  Synthetic Polypeptide encoding a heavy chain variable (vH) fragment

SEQ ID NO: 10907 - protein, 119 aa, Artificial Sequence; identical to SEQ ID NO: 4305
  Synthetic Polypeptide encoding a heavy chain variable (vH) fragment

SEQ ID NO: 10908 - protein, 120 aa, Artificial Sequence; identical to SEQ ID NO: 4306
  Synthetic Polypeptide encoding a heavy chain variable (vH) fragment

SEQ ID NO: 10909 - protein, 120 aa, Artificial Sequence; identical to SEQ ID NO: 4313
  Synthetic Polypeptide encoding a heavy chain variable (vH) fragment

SEQ ID NO: 10910 - protein, 120 aa, Artificial Sequence; identical to SEQ ID NO: 4314
  Synthetic Polypeptide encoding a heavy chain variable (vH) fragment

SEQ ID NO: 10911 - protein, 124 aa, Artificial Sequence; identical to SEQ ID NO: 4315
  Synthetic Polypeptide encoding a heavy chain variable (vH) fragment

SEQ ID NO: 10912 - protein, 118 aa, Artificial Sequence; identical to SEQ ID NO: 4316
  Synthetic Polypeptide encoding a heavy chain variable (vH) fragment

SEQ ID NO: 10913 - protein, 115 aa, Artificial Sequence; identical to SEQ ID NO: 4317
  Synthetic Polypeptide encoding a heavy chain variable (vH) fragment

SEQ ID NO: 10914 - protein, 119 aa, Artificial Sequence; identical to SEQ ID NO: 4318
  Synthetic Polypeptide encoding a heavy chain variable (vH) fragment

SEQ ID NO: 10915 - protein, 123 aa, Artificial Sequence [sequence omitted]

SEQ ID NO: 10916 - protein, 116 aa, Artificial Sequence; identical to SEQ ID NO: 4320
  Synthetic Polypeptide encoding a heavy chain variable (vH) fragment

SEQ ID NO: 10917 - protein, 114 aa, Artificial Sequence; identical to SEQ ID NO: 4321
  Synthetic Polypeptide encoding a heavy chain variable (vH) fragment

SEQ ID NO: 10918 - protein, 127 aa, Artificial Sequence; identical to SEQ ID NO: 4322
  Synthetic Polypeptide encoding a heavy chain variable (vH) fragment

SEQ ID NO: 10919 - protein, 120 aa, Artificial Sequence; identical to SEQ ID NO: 4323
  Synthetic Polypeptide encoding a heavy chain variable (vH) fragment

SEQ ID NO: 10920 - protein, 117 aa, Artificial Sequence; identical to SEQ ID NO: 4324
  Synthetic Polypeptide encoding a heavy chain variable (vH) fragment

SEQ ID NO: 10921 - protein, 124 aa, Artificial Sequence; identical to SEQ ID NO: 4327
  Synthetic Polypeptide encoding a heavy chain variable (vH) fragment

SEQ ID NO: 10922 - protein, 122 aa, Artificial Sequence [sequence omitted]

SEQ ID NO: 10923 - protein, 118 aa, Artificial Sequence; identical to SEQ ID NO: 4329
  Synthetic Polypeptide encoding a heavy chain variable (vH) fragment

SEQ ID NO: 10924 - protein, 124 aa, Artificial Sequence; identical to SEQ ID NO: 4330
  Synthetic Polypeptide encoding a heavy chain variable (vH) fragment

SEQ ID NO: 10925 - protein, 113 aa, Artificial Sequence; identical to SEQ ID NO: 4331
  Synthetic Polypeptide encoding a heavy chain variable (vH) fragment

SEQ ID NO: 10926 - protein, 121 aa, Artificial Sequence; identical to SEQ ID NO: 4332
  Synthetic Polypeptide encoding a heavy chain variable (vH) fragment

SEQ ID NO: 10927 - protein, 119 aa, Artificial Sequence; identical to SEQ ID NO: 4333
  Synthetic Polypeptide encoding a heavy chain variable (vH) fragment

SEQ ID NO: 10928 - protein, 123 aa, Artificial Sequence; identical to SEQ ID NO: 4334
  Synthetic Polypeptide encoding a heavy chain variable (vH) fragment

SEQ ID NO: 10929 - protein, 118 aa, Artificial Sequence; identical to SEQ ID NO: 4335
  Synthetic Polypeptide encoding a heavy chain variable (vH) fragment

SEQ ID NO: 10930 - protein, 121 aa, Artificial Sequence; identical to SEQ ID NO: 4336
  Synthetic Polypeptide encoding a heavy chain variable (vH) fragment

SEQ ID NO: 10931 - protein, 122 aa, Artificial Sequence; identical to SEQ ID NO: 4337
  Synthetic Polypeptide encoding a heavy chain variable (vH) fragment

SEQ ID NO: 10932 - protein, 124 aa, Artificial Sequence; identical to SEQ ID NO: 4338
  Synthetic Polypeptide encoding a heavy chain variable (vH) fragment

SEQ ID NO: 10933 - protein, 119 aa, Artificial Sequence; identical to SEQ ID NO: 4339
  Synthetic Polypeptide encoding a heavy chain variable (vH) fragment

SEQ ID NO: 10934 - protein, 115 aa, Artificial Sequence; identical to SEQ ID NO: 4340
  Synthetic Polypeptide encoding a heavy chain variable (vH) fragment

SEQ ID NO: 10935 - protein, 119 aa, Artificial Sequence [sequence omitted]

SEQ ID NO: 10936 - protein, 116 aa, Artificial Sequence; identical to SEQ ID NO: 4342
  Synthetic Polypeptide encoding a heavy chain variable (vH) fragment

SEQ ID NO: 10937 - protein, 117 aa, Artificial Sequence; identical to SEQ ID NO: 4343
  Synthetic Polypeptide encoding a heavy chain variable (vH) fragment

SEQ ID NO: 10938 - protein, 120 aa, Artificial Sequence; identical to SEQ ID NO: 4346
  Synthetic Polypeptide encoding a heavy chain variable (vH) fragment

SEQ ID NO: 10939 - protein, 118 aa, Artificial Sequence; identical to SEQ ID NO: 4348
  Synthetic Polypeptide encoding a heavy chain variable (vH) fragment

SEQ ID NO: 10940 - protein, 129 aa, Artificial Sequence; identical to SEQ ID NO: 4347
  Synthetic Polypeptide encoding a heavy chain variable (vH) fragment

SEQ ID NO: 10941 - protein, 135 aa, Artificial Sequence; identical to SEQ ID NO: 4349
  Synthetic Polypeptide encoding a heavy chain variable (vH) fragment

SEQ ID NO: 10942 - protein, 121 aa, Artificial Sequence; identical to SEQ ID NO: 4350
  Synthetic Polypeptide encoding a heavy chain variable (vH) fragment

SEQ ID NO: 10943 - protein, 128 aa, Artificial Sequence; identical to SEQ ID NO: 4351
  Synthetic Polypeptide encoding a heavy chain variable (vH) fragment

SEQ ID NO: 10944 - protein, 122 aa, Artificial Sequence; identical to SEQ ID NO: 4353
  Synthetic Polypeptide encoding a heavy chain variable (vH) fragment

SEQ ID NO: 10945 - protein, 122 aa, Artificial Sequence; identical to SEQ ID NO: 4356
  Synthetic Polypeptide encoding a heavy chain variable (vH) fragment

SEQ ID NO: 10946 - protein, 124 aa, Artificial Sequence; identical to SEQ ID NO: 4357
  Synthetic Polypeptide encoding a heavy chain variable (vH) fragment

SEQ ID NO: 10947 - protein, 118 aa, Artificial Sequence; identical to SEQ ID NO: 4358
  Synthetic Polypeptide encoding a heavy chain variable (vH) fragment

SEQ ID NO: 10948 - protein, 116 aa, Artificial Sequence; identical to SEQ ID NO: 4359
  Synthetic Polypeptide encoding a heavy chain variable (vH) fragment

SEQ ID NO: 10949 - protein, 122 aa, Artificial Sequence; identical to SEQ ID NO: 4360
  Synthetic Polypeptide encoding a heavy chain variable (vH) fragment

SEQ ID NO: 10950 - protein, 107 aa, Artificial Sequence; identical to SEQ ID NO: 4361
  Synthetic Polypeptide encoding a heavy chain variable (vH) fragment

SEQ ID NO: 10951 - protein, 128 aa, Artificial Sequence; identical to SEQ ID NO: 4362
  Synthetic Polypeptide encoding a heavy chain variable (vH) fragment

SEQ ID NO: 10952 - protein, 121 aa, Artificial Sequence; identical to SEQ ID NO: 4363
  Synthetic Polypeptide encoding a heavy chain variable (vH) fragment

SEQ ID NO: 10953 - protein, 122 aa, Artificial Sequence; identical to SEQ ID NO: 4304
  Synthetic Polypeptide encoding a heavy chain variable (vH) fragment

SEQ ID NO: 10954 - protein, 117 aa, Artificial Sequence; identical to SEQ ID NO: 4365
  Synthetic Polypeptide encoding a heavy chain variable (vH) fragment

SEQ ID NO: 10955 - protein, 118 aa, Artificial Sequence; identical to SEQ ID NO: 4366
  Synthetic Polypeptide encoding a heavy chain variable (vH) fragment

SEQ ID NO: 10956 - protein, 119 aa, Artificial Sequence; identical to SEQ ID NO: 4367
  Synthetic Polypeptide encoding a heavy chain variable (vH) fragment

SEQ ID NO: 10957 - protein, 118 aa, Artificial Sequence; identical to SEQ ID NO: 4368
  Synthetic Polypeptide encoding a heavy chain variable (vH) fragment

SEQ ID NO: 10958 - protein, 119 aa, Artificial Sequence; identical to SEQ ID NO: 4369
  Synthetic Polypeptide encoding a heavy chain variable (vH) fragment

SEQ ID NO: 10959 - protein, 127 aa, Artificial Sequence; identical to SEQ ID NO: 4370
  Synthetic Polypeptide encoding a heavy chain variable (vH) fragment

SEQ ID NO: 10960 - protein, 120 aa, Artificial Sequence; identical to SEQ ID NO: 4371
  Synthetic Polypeptide encoding a heavy chain variable (vH) fragment

SEQ ID NO: 10961 - protein, 118 aa, Artificial Sequence; identical to SEQ ID NO: 4372
  Synthetic Polypeptide encoding a heavy chain variable (vH) fragment

SEQ ID NO: 10962 - protein, 119 aa, Artificial Sequence; identical to SEQ ID NO: 4373
  Synthetic Polypeptide encoding a heavy chain variable (vH) fragment

SEQ ID NO: 10963 - protein, 119 aa, Artificial Sequence; identical to SEQ ID NO: 4373
  Synthetic Polypeptide encoding a heavy chain variable (vH) fragment

SEQ ID NO: 10964 - protein, 118 aa, Artificial Sequence; identical to SEQ ID NO: 4375
  Synthetic Polypeptide encoding a heavy chain variable (vH) fragment

SEQ ID NO: 10965 - protein, 118 aa, Artificial Sequence; identical to SEQ ID NO: 4376
  Synthetic Polypeptide encoding a heavy chain variable (vH) fragment

SEQ ID NO: 10966 - protein, 118 aa, Artificial Sequence; identical to SEQ ID NO: 4376
  Synthetic Polypeptide encoding a heavy chain variable (vH) fragment

SEQ ID NO: 10967 - protein, 120 aa, Artificial Sequence; identical to SEQ ID NO: 4378
  Synthetic Polypeptide encoding a heavy chain variable (vH) fragment

SEQ ID NO: 10968 - protein, 115 aa, Artificial Sequence; identical to SEQ ID NO: 4379
  Synthetic Polypeptide encoding a heavy chain variable (vH) fragment

SEQ ID NO: 10969 - protein, 118 aa, Artificial Sequence; identical to SEQ ID NO: 4380
  Synthetic Polypeptide encoding a heavy chain variable (vH) fragment

SEQ ID NO: 10970 - protein, 113 aa, Artificial Sequence; identical to SEQ ID NO: 4381
  Synthetic Polypeptide encoding a heavy chain variable (vH) fragment

SEQ ID NO: 10971 - protein, 115 aa, Artificial Sequence; identical to SEQ ID NO: 4382
  Synthetic Polypeptide encoding a heavy chain variable (vH) fragment

SEQ ID NO: 10972 - protein, 123 aa, Artificial Sequence; identical to SEQ ID NO: 4383
  Synthetic Polypeptide encoding a heavy chain variable (vH) fragment

SEQ ID NO: 10973 - protein, 121 aa, Artificial Sequence; identical to SEQ ID NO: 4384
  Synthetic Polypeptide encoding a heavy chain variable (vH) fragment

SEQ ID NO: 10974 - protein, 122 aa, Artificial Sequence; identical to SEQ ID NO: 4385
  Synthetic Polypeptide encoding a heavy chain variable (vH) fragment

SEQ ID NO: 10975 - protein, 115 aa, Artificial Sequence; identical to SEQ ID NO: 4386
  Synthetic Polypeptide encoding a heavy chain variable (vH) fragment

SEQ ID NO: 10976 - protein, 114 aa, Artificial Sequence; identical to SEQ ID NO: 4387
  Synthetic Polypeptide encoding a heavy chain variable (vH) fragment

SEQ ID NO: 10977 - protein, 118 aa, Artificial Sequence; identical to SEQ ID NO: 4388
  Synthetic Polypeptide encoding a heavy chain variable (vH) fragment

SEQ ID NO: 10978 - protein, 119 aa, Artificial Sequence; identical to SEQ ID NO: 4389
  Synthetic Polypeptide encoding a heavy chain variable (vH) fragment

SEQ ID NO: 10979 - protein, 113 aa, Artificial Sequence; identical to SEQ ID NO: 4390
  Synthetic Polypeptide encoding a heavy chain variable (vH) fragment

SEQ ID NO: 10980 - protein, 110 aa, Artificial Sequence; identical to SEQ ID NO: 4391
  Synthetic Polypeptide encoding a heavy chain variable (vH) fragment

SEQ ID NO: 10981 - protein, 118 aa, Artificial Sequence [sequence omitted]

SEQ ID NO: 10982 - protein, 115 aa, Artificial Sequence; identical to SEQ ID NO: 4393
  Synthetic Polypeptide encoding a heavy chain variable (vH) fragment

SEQ ID NO: 10983 - protein, 107 aa, Artificial Sequence; identical to SEQ ID NO: 4394
  Synthetic Polypeptide encoding a heavy chain variable (vH) fragment

SEQ ID NO: 10984 - protein, 134 aa, Artificial Sequence; identical to SEQ ID NO: 4395
  Synthetic Polypeptide encoding a heavy chain variable (vH) fragment

SEQ ID NO: 10985 - protein, 130 aa, Artificial Sequence; identical to SEQ ID NO: 4396
  Synthetic Polypeptide encoding a heavy chain variable (vH) fragment

SEQ ID NO: 10986 - protein, 123 aa, Artificial Sequence; identical to SEQ ID NO: 4397
  Synthetic Polypeptide encoding a heavy chain variable (vH) fragment

SEQ ID NO: 10987 - protein, 115 aa, Artificial Sequence; identical to SEQ ID NO: 4398
  Synthetic Polypeptide encoding a heavy chain variable (vH) fragment

SEQ ID NO: 10988 - protein, 120 aa, Artificial Sequence; identical to SEQ ID NO: 4399
  Synthetic Polypeptide encoding a heavy chain variable (vH) fragment

SEQ ID NO: 10989 - protein, 115 aa, Artificial Sequence; identical to SEQ ID NO: 4400
  Synthetic Polypeptide encoding a heavy chain variable (vH) fragment

SEQ ID NO: 10990 - protein, 119 aa, Artificial Sequence; identical to SEQ ID NO: 4401
  Synthetic Polypeptide encoding a heavy chain variable (vH) fragment

SEQ ID NO: 10991 - protein, 120 aa, Artificial Sequence; identical to SEQ ID NO: 4402
  Synthetic Polypeptide encoding a heavy chain variable (vH) fragment

SEQ ID NO: 10992 - protein, 123 aa, Artificial Sequence; identical to SEQ ID NO: 4403
  Synthetic Polypeptide encoding a heavy chain variable (vH) fragment

SEQ ID NO: 10993 - protein, 126 aa, Artificial Sequence; identical to SEQ ID NO: 4404
  Synthetic Polypeptide encoding a heavy chain variable (vH) fragment

SEQ ID NO: 10994 - protein, 119 aa, Artificial Sequence; identical to SEQ ID NO: 4405
  Synthetic Polypeptide encoding a heavy chain variable (vH) fragment

SEQ ID NO: 10995 - protein, 120 aa, Artificial Sequence; identical to SEQ ID NO: 4406
  Synthetic Polypeptide encoding a heavy chain variable (vH) fragment

SEQ ID NO: 10996 - protein, 124 aa, Artificial Sequence; identical to SEQ ID NO: 4407
  Synthetic Polypeptide encoding a heavy chain variable (vH) fragment

SEQ ID NO: 10997 - protein, 119 aa, Artificial Sequence; identical to SEQ ID NO: 4408
  Synthetic Polypeptide encoding a heavy chain variable (vH) fragment

SEQ ID NO: 10998 - protein, 118 aa, Artificial Sequence; identical to SEQ ID NO: 4409
  Synthetic Polypeptide encoding a heavy chain variable (vH) fragment

SEQ ID NO: 10999 - protein, 119 aa, Artificial Sequence; identical to SEQ ID NO: 4410
  Synthetic Polypeptide encoding a heavy chain variable (vH) fragment

SEQ ID NO: 11000 - protein, 123 aa, Artificial Sequence; identical to SEQ ID NO: 4411
  Synthetic Polypeptide encoding a heavy chain variable (vH) fragment

SEQ ID NO: 11001 - protein, 119 aa, Artificial Sequence; identical to SEQ ID NO: 4412
  Synthetic Polypeptide encoding a heavy chain variable (vH) fragment

SEQ ID NO: 11002 - protein, 121 aa, Artificial Sequence; identical to SEQ ID NO: 4414
  Synthetic Polypeptide encoding a heavy chain variable (vH) fragment

SEQ ID NO: 11003 - protein, 123 aa, Artificial Sequence; identical to SEQ ID NO: 4415
  Synthetic Polypeptide encoding a heavy chain variable (vH) fragment

SEQ ID NO: 11004 - protein, 120 aa, Artificial Sequence; identical to SEQ ID NO: 4416
  Synthetic Polypeptide encoding a heavy chain variable (vH) fragment

SEQ ID NO: 11005 - protein, 116 aa, Artificial Sequence; identical to SEQ ID NO: 4417
  Synthetic Polypeptide encoding a heavy chain variable (vH) fragment

SEQ ID NO: 11006 - protein, 116 aa, Artificial Sequence; identical to SEQ ID NO: 4418
  Synthetic Polypeptide encoding a heavy chain variable (vH) fragment

SEQ ID NO: 11007 - protein, 121 aa, Artificial Sequence; identical to SEQ ID NO: 4419
  Synthetic Polypeptide encoding a heavy chain variable (vH) fragment

SEQ ID NO: 11008 - protein, 119 aa, Artificial Sequence; identical to SEQ ID NO: 4420
  Synthetic Polypeptide encoding a heavy chain variable (vH) fragment

SEQ ID NO: 11009 - protein, 126 aa, Artificial Sequence; identical to SEQ ID NO: 4421
  Synthetic Polypeptide encoding a heavy chain variable (vH) fragment

SEQ ID NO: 11010 - protein, 119 aa, Artificial Sequence; identical to SEQ ID NO: 4422
  Synthetic Polypeptide encoding a heavy chain variable (vH) fragment

SEQ ID NO: 11011 - protein, 117 aa, Artificial Sequence; identical to SEQ ID NO: 4423
  Synthetic Polypeptide encoding a heavy chain variable (vH) fragment

SEQ ID NO: 11012 - protein, 122 aa, Artificial Sequence; identical to SEQ ID NO: 4424
  Synthetic Polypeptide encoding a heavy chain variable (vH) fragment

SEQ ID NO: 11013 - protein, 121 aa, Artificial Sequence; identical to SEQ ID NO: 4425
  Synthetic Polypeptide encoding a heavy chain variable (vH) fragment

SEQ ID NO: 11014 - protein, 119 aa, Artificial Sequence; identical to SEQ ID NO: 4426
  Synthetic Polypeptide encoding a heavy chain variable (vH) fragment

SEQ ID NO: 11015 - protein, 123 aa, Artificial Sequence; identical to SEQ ID NO: 4427
  Synthetic Polypeptide encoding a heavy chain variable (vH) fragment

SEQ ID NO: 11016 - protein, 123 aa, Artificial Sequence; identical to SEQ ID NO: 4428
  Synthetic Polypeptide encoding a heavy chain variable (vH) fragment

SEQ ID NO: 11017 - protein, 121 aa, Artificial Sequence; identical to SEQ ID NO: 4429
  Synthetic Polypeptide encoding a heavy chain variable (vH) fragment

SEQ ID NO: 11018 - protein, 118 aa, Artificial Sequence; identical to SEQ ID NO: 4430
  Synthetic Polypeptide encoding a heavy chain variable (vH) fragment

SEQ ID NO: 11019 - protein, 119 aa, Artificial Sequence; identical to SEQ ID NO: 4431
  Synthetic Polypeptide encoding a heavy chain variable (vH) fragment

SEQ ID NO: 11020 - protein, 121 aa, Artificial Sequence; identical to SEQ ID NO: 4432
  Synthetic Polypeptide encoding a heavy chain variable (vH) fragment

SEQ ID NO: 11021 - protein, 121 aa, Artificial Sequence; identical to SEQ ID NO: 4433
  Synthetic Polypeptide encoding a heavy chain variable (vH) fragment

SEQ ID NO: 11022 - protein, 120 aa, Artificial Sequence; identical to SEQ ID NO: 4434
  Synthetic Polypeptide encoding a heavy chain variable (vH) fragment

SEQ ID NO: 11023 - protein, 118 aa, Artificial Sequence; identical to SEQ ID NO: 4222
  Synthetic Polypeptide encoding a heavy chain variable (vH) fragment

SEQ ID NO: 11024 - protein, 119 aa, Artificial Sequence; identical to SEQ ID NO: 4435
  Synthetic Polypeptide encoding a heavy chain variable (vH) fragment

SEQ ID NO: 11025 - protein, 118 aa, Artificial Sequence; identical to SEQ ID NO: 4436
  Synthetic Polypeptide encoding a heavy chain variable (vH) fragment

SEQ ID NO: 11026 - protein, 121 aa, Artificial Sequence; identical to SEQ ID NO: 4437
  Synthetic Polypeptide encoding a heavy chain variable (vH) fragment

SEQ ID NO: 11027 - protein, 113 aa, Artificial Sequence; identical to SEQ ID NO: 4438
  Synthetic Polypeptide encoding a heavy chain variable (vH) fragment

SEQ ID NO: 11028 - protein, 116 aa, Artificial Sequence; identical to SEQ ID NO: 4439
  Synthetic Polypeptide encoding a heavy chain variable (vH) fragment

SEQ ID NO: 11029 - protein, 121 aa, Artificial Sequence; identical to SEQ ID NO: 4440
  Synthetic Polypeptide encoding a heavy chain variable (vH) fragment

SEQ ID NO: 11030 - protein, 121 aa, Artificial Sequence [sequence omitted]

SEQ ID NO: 11031 - protein, 118 aa, Artificial Sequence; identical to SEQ ID NO: 4442
  Synthetic Polypeptide encoding a heavy chain variable (vH) fragment

SEQ ID NO: 11032 - protein, 119 aa, Artificial Sequence; identical to SEQ ID NO: 4443
  Synthetic Polypeptide encoding a heavy chain variable (vH) fragment

SEQ ID NO: 11033 - protein, 120 aa, Artificial Sequence; identical to SEQ ID NO: 4444
  Synthetic Polypeptide encoding a heavy chain variable (vH) fragment

SEQ ID NO: 11034 - protein, 124 aa, Artificial Sequence; identical to SEQ ID NO: 4445
  Synthetic Polypeptide encoding a heavy chain variable (vH) fragment

SEQ ID NO: 11035 - protein, 117 aa, Artificial Sequence; identical to SEQ ID NO: 4207
  Synthetic Polypeptide encoding a heavy chain variable (vH) fragment

SEQ ID NO: 11036 - protein, 124 aa, Artificial Sequence; identical to SEQ ID NO: 4208
  Synthetic Polypeptide encoding a heavy chain variable (vH) fragment

SEQ ID NO: 11037 - protein, 126 aa, Artificial Sequence; identical to SEQ ID NO: 4209
  Synthetic Polypeptide encoding a heavy chain variable (vH) fragment

SEQ ID NO: 11038 - protein, 125 aa, Artificial Sequence; identical to SEQ ID NO: 4217
  Synthetic Polypeptide encoding a heavy chain variable (vH) fragment

SEQ ID NO: 11039 - protein, 117 aa, Artificial Sequence; identical to SEQ ID NO: 4218
  Synthetic Polypeptide encoding a heavy chain variable (vH) fragment

SEQ ID NO: 11040 - protein, 117 aa, Artificial Sequence; identical to SEQ ID NO: 4219
  Synthetic Polypeptide encoding a heavy chain variable (vH) fragment

SEQ ID NO: 11041 - protein, 120 aa, Artificial Sequence; identical to SEQ ID NO: 4223
  Synthetic Polypeptide encoding a heavy chain variable (vH) fragment

SEQ ID NO: 11042 - protein, 120 aa, Artificial Sequence; identical to SEQ ID NO: 4224
  Synthetic Polypeptide encoding a heavy chain variable (vH) fragment

SEQ ID NO: 11043 - protein, 118 aa, Artificial Sequence; identical to SEQ ID NO: 4225
  Synthetic Polypeptide encoding a heavy chain variable (vH) fragment

SEQ ID NO: 11044 - protein, 118 aa, Artificial Sequence; identical to SEQ ID NO: 4226
  Synthetic Polypeptide encoding a heavy chain variable (vH) fragment

SEQ ID NO: 11045 - protein, 119 aa, Artificial Sequence; identical to SEQ ID NO: 4227
  Synthetic Polypeptide encoding a heavy chain variable (vH) fragment

SEQ ID NO: 11046 - protein, 119 aa, Artificial Sequence; identical to SEQ ID NO: 4228
  Synthetic Polypeptide encoding a heavy chain variable (vH) fragment

SEQ ID NO: 11047 - protein, 115 aa, Artificial Sequence; identical to SEQ ID NO: 4229
  Synthetic Polypeptide encoding a heavy chain variable (vH) fragment

SEQ ID NO: 11048 - protein, 119 aa, Artificial Sequence; identical to SEQ ID NO: 4230
  Synthetic Polypeptide encoding a heavy chain variable (vH) fragment

SEQ ID NO: 11049 - protein, 119 aa, Artificial Sequence; identical to SEQ ID NO: 4231
  Synthetic Polypeptide encoding a heavy chain variable (vH) fragment

SEQ ID NO: 11050 - protein, 121 aa, Artificial Sequence; identical to SEQ ID NO: 4232
  Synthetic Polypeptide encoding a heavy chain variable (vH) fragment

SEQ ID NO: 11051 - protein, 125 aa, Artificial Sequence; identical to SEQ ID NO: 4233
  Synthetic Polypeptide encoding a heavy chain variable (vH) fragment

SEQ ID NO: 11052 - protein, 121 aa, Artificial Sequence; identical to SEQ ID NO: 4243
  Synthetic Polypeptide encoding a heavy chain variable (vH) fragment

SEQ ID NO: 11053 - protein, 121 aa, Artificial Sequence; identical to SEQ ID NO: 4244
  Synthetic Polypeptide encoding a heavy chain variable (vH) fragment

SEQ ID NO: 11054 - protein, 121 aa, Artificial Sequence; identical to SEQ ID NO: 4245
  Synthetic Polypeptide encoding a heavy chain variable (vH) fragment

SEQ ID NO: 11055 - protein, 123 aa, Artificial Sequence; identical to SEQ ID NO: 4246
  Synthetic Polypeptide encoding a heavy chain variable (vH) fragment

SEQ ID NO: 11056 - protein, 120 aa, Artificial Sequence; identical to SEQ ID NO: 4247
  Synthetic Polypeptide encoding a heavy chain variable (vH) fragment

SEQ ID NO: 11057 - protein, 121 aa, Artificial Sequence; identical to SEQ ID NO: 4248
  Synthetic Polypeptide encoding a heavy chain variable (vH) fragment

SEQ ID NO: 11058 - protein, 120 aa, Artificial Sequence; identical to SEQ ID NO: 4249
  Synthetic Polypeptide encoding a heavy chain variable (vH) fragment

SEQ ID NO: 11059 - protein, 121 aa, Artificial Sequence; identical to SEQ ID NO: 4250
  Synthetic Polypeptide encoding a heavy chain variable (vH) fragment

SEQ ID NO: 11060 - protein, 124 aa, Artificial Sequence; identical to SEQ ID NO: 4251
  Synthetic Polypeptide encoding a heavy chain variable (vH) fragment

SEQ ID NO: 11061 - protein, 122 aa, Artificial Sequence; identical to SEQ ID NO: 4254
  Synthetic Polypeptide encoding a heavy chain variable (vH) fragment

SEQ ID NO: 11062 - protein, 125 aa, Artificial Sequence; identical to SEQ ID NO: 4255
  Synthetic Polypeptide encoding a heavy chain variable (vH) fragment

SEQ ID NO: 11063 - protein, 123 aa, Artificial Sequence; identical to SEQ ID NO: 4256
  Synthetic Polypeptide encoding a heavy chain variable (vH) fragment

SEQ ID NO: 11064 - protein, 122 aa, Artificial Sequence [sequence omitted]

SEQ ID NO: 11065 - protein, 121 aa, Artificial Sequence; identical to SEQ ID NO: 4258
  Synthetic Polypeptide encoding a heavy chain variable (vH) fragment

SEQ ID NO: 11066 - protein, 128 aa, Artificial Sequence; identical to SEQ ID NO: 4259
  Synthetic Polypeptide encoding a heavy chain variable (vH) fragment

SEQ ID NO: 11067 - protein, 120 aa, Artificial Sequence; identical to SEQ ID NO: 4260
  Synthetic Polypeptide encoding a heavy chain variable (vH) fragment

SEQ ID NO: 11068 - protein, 122 aa, Artificial Sequence; identical to SEQ ID NO: 4262
  Synthetic Polypeptide encoding a heavy chain variable (vH) fragment

SEQ ID NO: 11069 - protein, 122 aa, Artificial Sequence; identical to SEQ ID NO: 4263
  Synthetic Polypeptide encoding a heavy chain variable (vH) fragment

SEQ ID NO: 11070 - protein, 121 aa, Artificial Sequence; identical to SEQ ID NO: 4264
  Synthetic Polypeptide encoding a heavy chain variable (vH) fragment

SEQ ID NO: 11071 - protein, 119 aa, Artificial Sequence; identical to SEQ ID NO: 4276
  Synthetic Polypeptide encoding a heavy chain variable (vH) fragment

SEQ ID NO: 11072 - protein, 122 aa, Artificial Sequence; identical to SEQ ID NO: 4277
  Synthetic Polypeptide encoding a heavy chain variable (vH) fragment

SEQ ID NO: 11073 - protein, 117 aa, Artificial Sequence; identical to SEQ ID NO: 4278
  Synthetic Polypeptide encoding a heavy chain variable (vH) fragment

SEQ ID NO: 11074 - protein, 117 aa, Artificial Sequence; identical to SEQ ID NO: 4279
  Synthetic Polypeptide encoding a heavy chain variable (vH) fragment

SEQ ID NO: 11075 - protein, 117 aa, Artificial Sequence; identical to SEQ ID NO: 4280
  Synthetic Polypeptide encoding a heavy chain variable (vH) fragment

SEQ ID NO: 11076 - protein, 117 aa, Artificial Sequence; identical to SEQ ID NO: 4280
  Synthetic Polypeptide encoding a heavy chain variable (vH) fragment

SEQ ID NO: 11077 - protein, 118 aa, Artificial Sequence; identical to SEQ ID NO: 4282
  Synthetic Polypeptide encoding a heavy chain variable (vH) fragment

SEQ ID NO: 11078 - protein, 114 aa, Artificial Sequence; identical to SEQ ID NO: 4290
  Synthetic Polypeptide encoding a heavy chain variable (vH) fragment

SEQ ID NO: 11079 - protein, 121 aa, Artificial Sequence; identical to SEQ ID NO: 4299
  Synthetic Polypeptide encoding a heavy chain variable (vH) fragment

SEQ ID NO: 11080 - protein, 122 aa, Artificial Sequence; identical to SEQ ID NO: 4300
  Synthetic Polypeptide encoding a heavy chain variable (vH) fragment

SEQ ID NO: 11081 - protein, 123 aa, Artificial Sequence; identical to SEQ ID NO: 4301
  Synthetic Polypeptide encoding a heavy chain variable (vH) fragment

SEQ ID NO: 11082 - protein, 123 aa, Artificial Sequence; identical to SEQ ID NO: 4302
  Synthetic Polypeptide encoding a heavy chain variable (vH) fragment

SEQ ID NO: 11083 - protein, 120 aa, Artificial Sequence; identical to SEQ ID NO: 4307
  Synthetic Polypeptide encoding a heavy chain variable (vH) fragment

SEQ ID NO: 11084 - protein, 117 aa, Artificial Sequence; identical to SEQ ID NO: 4308
  Synthetic Polypeptide encoding a heavy chain variable (vH) fragment

SEQ ID NO: 11085 - protein, 117 aa, Artificial Sequence; identical to SEQ ID NO: 4309
  Synthetic Polypeptide encoding a heavy chain variable (vH) fragment

SEQ ID NO: 11086 - protein, 117 aa, Artificial Sequence; identical to SEQ ID NO: 4310
  Synthetic Polypeptide encoding a heavy chain variable (vH) fragment

SEQ ID NO: 11087 - protein, 121 aa, Artificial Sequence; identical to SEQ ID NO: 4311
  Synthetic Polypeptide encoding a heavy chain variable (vH) fragment

SEQ ID NO: 11088 - protein, 120 aa, Artificial Sequence; identical to SEQ ID NO: 4312
  Synthetic Polypeptide encoding a heavy chain variable (vH) fragment

SEQ ID NO: 11089 - protein, 118 aa, Artificial Sequence; identical to SEQ ID NO: 4325
  Synthetic Polypeptide encoding a heavy chain variable (vH) fragment

SEQ ID NO: 11090 - protein, 126 aa, Artificial Sequence [sequence omitted]

SEQ ID NO: 11091 - protein, 114 aa, Artificial Sequence; identical to SEQ ID NO: 4344
  Synthetic Polypeptide encoding a heavy chain variable (vH) fragment

SEQ ID NO: 11092 - protein, 118 aa, Artificial Sequence; identical to SEQ ID NO: 4345
  Synthetic Polypeptide encoding a heavy chain variable (vH) fragment

SEQ ID NO: 11093 - protein, 123 aa, Artificial Sequence; identical to SEQ ID NO: 4352
  Synthetic Polypeptide encoding a heavy chain variable (vH) fragment

SEQ ID NO: 11094 - protein, 122 aa, Artificial Sequence; identical to SEQ ID NO: 4354
  Synthetic Polypeptide encoding a heavy chain variable (vH) fragment

SEQ ID NO: 11095 - protein, 122 aa, Artificial Sequence; identical to SEQ ID NO: 4355
  Synthetic Polypeptide encoding a heavy chain variable (vH) fragment

SEQ ID NO: 11096 - protein, 118 aa, Artificial Sequence; identical to SEQ ID NO: 4413
  Synthetic Polypeptide encoding a heavy chain variable (vH) fragment

SEQ ID NO: 11097 - protein, 116 aa, Artificial Sequence; identical to SEQ ID NO: 4446
  Synthetic Polypeptide encoding a heavy chain variable (vH) fragment

SEQ ID NO: 11098 - protein, 114 aa, Artificial Sequence; identical to SEQ ID NO: 4447
  Synthetic Polypeptide encoding a heavy chain variable (vH) fragment

SEQ ID NO: 11099 - protein, 126 aa, Artificial Sequence; identical to SEQ ID NO: 4448
  Synthetic Polypeptide encoding a heavy chain variable (vH) fragment

SEQ ID NO: 11100 - protein, 112 aa, Artificial Sequence; identical to SEQ ID NO: 4449
  Synthetic Polypeptide encoding a heavy chain variable (vH) fragment

SEQ ID NO: 11101 - protein, 130 aa, Artificial Sequence; identical to SEQ ID NO: 4450
  Synthetic Polypeptide encoding a heavy chain variable (vH) fragment

SEQ ID NO: 11102 - protein, 117 aa, Artificial Sequence; identical to SEQ ID NO: 4451
  Synthetic Polypeptide encoding a heavy chain variable (vH) fragment

SEQ ID NO: 11103 - protein, 119 aa, Artificial Sequence; identical to SEQ ID NO: 4452
  Synthetic Polypeptide encoding a heavy chain variable (vH) fragment

SEQ ID NO: 11104 - protein, 117 aa, Artificial Sequence; identical to SEQ ID NO: 4453
  Synthetic Polypeptide encoding a heavy chain variable (vH) fragment

SEQ ID NO: 11105 - protein, 118 aa, Artificial Sequence; identical to SEQ ID NO: 4454
  Synthetic Polypeptide encoding a heavy chain variable (vH) fragment

SEQ ID NO: 11106 - protein, 122 aa, Artificial Sequence; identical to SEQ ID NO: 4455
  Synthetic Polypeptide encoding a heavy chain variable (vH) fragment

SEQ ID NO: 11107 - protein, 121 aa, Artificial Sequence; identical to SEQ ID NO: 4456
  Synthetic Polypeptide encoding a heavy chain variable (vH) fragment

SEQ ID NO: 11108 - protein, 117 aa, Artificial Sequence; identical to SEQ ID NO: 4457
  Synthetic Polypeptide encoding a heavy chain variable (vH) fragment

SEQ ID NO: 11109 - protein, 120 aa, Artificial Sequence; identical to SEQ ID NO: 4458
  Synthetic Polypeptide encoding a heavy chain variable (vH) fragment

SEQ ID NO: 11110 - protein, 120 aa, Artificial Sequence; identical to SEQ ID NO: 4459
  Synthetic Polypeptide encoding a heavy chain variable (vH) fragment

SEQ ID NO: 11111 - protein, 117 aa, Artificial Sequence; identical to SEQ ID NO: 4219
  Synthetic Polypeptide encoding a heavy chain variable (vH) fragment

SEQ ID NO: 11112 - protein, 117 aa, Artificial Sequence; identical to SEQ ID NO: 4215
  Synthetic Polypeptide encoding a heavy chain variable (vH) fragment

SEQ ID NO: 11113 - protein, 118 aa, Artificial Sequence; identical to SEQ ID NO: 4462
  Synthetic Polypeptide encoding a heavy chain variable (vH) fragment

SEQ ID NO: 11114 - protein, 119 aa, Artificial Sequence; identical to SEQ ID NO: 4463
  Synthetic Polypeptide encoding a heavy chain variable (vH) fragment

SEQ ID NO: 11115 - protein, 124 aa, Artificial Sequence; identical to SEQ ID NO: 4464
  Synthetic Polypeptide encoding a heavy chain variable (vH) fragment

SEQ ID NO: 11116 - protein, 127 aa, Artificial Sequence; identical to SEQ ID NO: 4465
  Synthetic Polypeptide encoding a heavy chain variable (vH) fragment

SEQ ID NO: 11117 - protein, 122 aa, Artificial Sequence; identical to SEQ ID NO: 4466
  Synthetic Polypeptide encoding a heavy chain variable (vH) fragment

SEQ ID NO: 11118 - protein, 127 aa, Artificial Sequence; identical to SEQ ID NO: 4467
  Synthetic Polypeptide encoding a heavy chain variable (vH) fragment

SEQ ID NO: 11119 - protein, 127 aa, Artificial Sequence; identical to SEQ ID NO: 4185
  Synthetic Polypeptide encoding a heavy chain variable (vH) fragment

SEQ ID NO: 11120 - protein, 120 aa, Artificial Sequence; identical to SEQ ID NO: 4469
  Synthetic Polypeptide encoding a heavy chain variable (vH) fragment

SEQ ID NO: 11121 - protein, 120 aa, Artificial Sequence; identical to SEQ ID NO: 4470
  Synthetic Polypeptide encoding a heavy chain variable (vH) fragment

SEQ ID NO: 11122 - protein, 118 aa, Artificial Sequence; identical to SEQ ID NO: 4471
  Synthetic Polypeptide encoding a heavy chain variable (vH) fragment

SEQ ID NO: 11123 - protein, 122 aa, Artificial Sequence; identical to SEQ ID NO: 4472
  Synthetic Polypeptide encoding a heavy chain variable (vH) fragment

SEQ ID NO: 11124 - protein, 120 aa, Artificial Sequence; identical to SEQ ID NO: 4473
  Synthetic Polypeptide encoding a heavy chain variable (vH) fragment

SEQ ID NO: 11125 - protein, 116 aa, Artificial Sequence
  Synthetic Polypeptide encoding a heavy chain variable (vH) fragment
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSS

SEQ ID NO: 11126 - protein, 116 aa, Artificial Sequence
  Synthetic Polypeptide encoding a heavy chain variable (vH) fragment
AVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSS

SEQ ID NO: 11127 - protein, 120 aa, Artificial Sequence
  Synthetic Polypeptide encoding a heavy chain variable (vH) fragment
EVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSS

SEQ ID NO: 11128 - protein, 120 aa, Artificial Sequence
  Synthetic Polypeptide encoding a heavy chain variable (vH) fragment
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 11129 - protein, 120 aa, Artificial Sequence
  Synthetic Polypeptide encoding a heavy chain variable (vH) fragment
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSS

SEQ ID NO: 11130 - protein, 120 aa, Artificial Sequence
  Synthetic Polypeptide encoding a heavy chain variable (vH) fragment
EVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSS

SEQ ID NO: 11131 - protein, 118 aa, Artificial Sequence
  Synthetic Polypeptide encoding a heavy chain variable (vH) fragment
QVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSS

SEQ ID NO: 11132 - protein, 122 aa, Artificial Sequence
  Synthetic Polypeptide encoding a heavy chain variable (vH) fragment
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS

SEQ ID NO: 11133 - protein, 119 aa, Artificial Sequence
  Synthetic Polypeptide encoding a heavy chain variable (vH) fragment
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS

SEQ ID NO: 11134 - protein, 120 aa, Artificial Sequence
  Synthetic Polypeptide encoding a heavy chain variable (vH) fragment
EVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSS

SEQ ID NO: 11135 - protein, 120 aa, Artificial Sequence
  Synthetic Polypeptide encoding a heavy chain variable (vH) fragment
EVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 11136 - protein, 129 aa, Artificial Sequence
  Synthetic Polypeptide encoding a heavy chain variable (vH) fragment
AGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSA

SEQ ID NO: 11137 - protein, 128 aa, Artificial Sequence
  Synthetic Polypeptide encoding a heavy chain variable (vH) fragment
ADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSA

SEQ ID NO: 11138 - protein, 129 aa, Artificial Sequence
  Synthetic Polypeptide encoding a heavy chain variable (vH) fragment
SAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPA

SEQ ID NO: 11139 - protein, 120 aa, Artificial Sequence
  Synthetic Polypeptide encoding a heavy chain variable (vH) fragment
QIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSA

SEQ ID NO: 11140 - protein, 120 aa, Artificial Sequence; identical to SEQ ID NO: 11139
  Synthetic Polypeptide encoding a heavy chain variable (vH) fragment

SEQ ID NO: 11141 - protein, 121 aa, Artificial Sequence
  Synthetic Polypeptide encoding a heavy chain variable (vH) fragment
HVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSP

SEQ ID NO: 11142 - protein, 120 aa, Artificial Sequence
  Synthetic Polypeptide encoding a heavy chain variable (vH) fragment
RAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTS

SEQ ID NO: 11143 - protein, 120 aa, Artificial Sequence
  Synthetic Polypeptide encoding a heavy chain variable (vH) fragment
RVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTS

SEQ ID NO: 11144 - protein, 130 aa, Artificial Sequence
  Synthetic Polypeptide encoding a heavy chain variable (vH) fragment
QVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSS

SEQ ID NO: 11145 - protein, 130 aa, Artificial Sequence
  Synthetic Polypeptide encoding a heavy chain variable (vH) fragment
QVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSS

SEQ ID NO: 11146 - protein, 118 aa, Artificial Sequence
  Synthetic Polypeptide encoding a heavy chain variable (vH) fragment
QLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSS

SEQ ID NO: 11147 - protein, 133 aa, Artificial Sequence
  Synthetic Polypeptide encoding a heavy chain variable (vH) fragment
LVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSS

SEQ ID NO: 11148 - protein, 131 aa, Artificial Sequence
  Synthetic Polypeptide encoding a heavy chain variable (vH) fragment
QVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCL

SEQ ID NO: 11149 - protein, 131 aa, Artificial Sequence
  Synthetic Polypeptide encoding a heavy chain variable (vH) fragment
QVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSS

SEQ ID NO: 11150 - protein, 131 aa, Artificial Sequence
  Synthetic Polypeptide encoding a heavy chain variable (vH) fragment
QVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSS

SEQ ID NO: 11151 - protein, 131 aa, Artificial Sequence
  Synthetic Polypeptide encoding a heavy chain variable (vH) fragment
QVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSS

SEQ ID NO: 11152 - protein, 131 aa, Artificial Sequence
  Synthetic Polypeptide encoding a heavy chain variable (vH) fragment
QVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSS

SEQ ID NO: 11153 - protein, 123 aa, Artificial Sequence
  Synthetic Polypeptide encoding a heavy chain variable (vH) fragment
DVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSS

SEQ ID NO: 11154 - protein, 123 aa, Artificial Sequence
  Synthetic Polypeptide encoding a heavy chain variable (vH) fragment
DVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSS

SEQ ID NO: 11155 - protein, 118 aa, Artificial Sequence
  Synthetic Polypeptide encoding a heavy chain variable (vH) fragment
QVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSS

SEQ ID NO: 11156 - protein, 125 aa, Artificial Sequence
  Synthetic Polypeptide encoding a heavy chain variable (vH) fragment
EVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSS

SEQ ID NO: 11157 - protein, 118 aa, Artificial Sequence
  Synthetic Polypeptide encoding a heavy chain variable (vH) fragment
EQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11158 - protein, 118 aa, Artificial Sequence; identical to SEQ ID NO: 11157
  Synthetic Polypeptide encoding a heavy chain variable (vH) fragment

SEQ ID NO: 11159 - protein, 118 aa, Artificial Sequence; identical to SEQ ID NO: 11157
  Synthetic Polypeptide encoding a heavy chain variable (vH) fragment

SEQ ID NO: 11160 - protein, 118 aa, Artificial Sequence; identical to SEQ ID NO: 11157
  Synthetic Polypeptide encoding a heavy chain variable (vH) fragment

SEQ ID NO: 11161 - protein, 118 aa, Artificial Sequence; identical to SEQ ID NO: 11157
  Synthetic Polypeptide encoding a heavy chain variable (vH) fragment

SEQ ID NO: 11162 - protein, 118 aa, Artificial Sequence; identical to SEQ ID NO: 11157
  Synthetic Polypeptide encoding a heavy chain variable (vH) fragment

SEQ ID NO: 11163 - protein, 118 aa, Artificial Sequence; identical to SEQ ID NO: 11157
  Synthetic Polypeptide encoding a heavy chain variable (vH) fragment

SEQ ID NO: 11164 - protein, 122 aa, Artificial Sequence; identical to SEQ ID NO: 4455
  Synthetic Polypeptide encoding a heavy chain variable (vH) fragment

SEQ ID NO: 11165 - protein, 242 aa, Artificial Sequence; identical to SEQ ID NO: 4555
  Synthetic Polypeptide encoding a scFv fragment

SEQ ID NO: 11166 - protein, 242 aa, Artificial Sequence; identical to SEQ ID NO: 4556
  Synthetic Polypeptide encoding a scFv fragment

SEQ ID NO: 11167 - protein, 242 aa, Artificial Sequence
  Synthetic Polypeptide encoding a scFv fragment
EIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSS

SEQ ID NO: 11168 - protein, 250 aa, Artificial Sequence; identical to SEQ ID NO: 4558
  Synthetic Polypeptide encoding a scFv fragment

SEQ ID NO: 11169 - protein, 249 aa, Artificial Sequence; identical to SEQ ID NO: 4559
  Synthetic Polypeptide encoding a scFv fragment

SEQ ID NO: 11170 - protein, 240 aa, Artificial Sequence; identical to SEQ ID NO: 4572
  Synthetic Polypeptide encoding a scFv fragment

SEQ ID NO: 11171 - protein, 251 aa, Artificial Sequence; identical to SEQ ID NO: 4573
  Synthetic Polypeptide encoding a scFv fragment

SEQ ID NO: 11172 - protein, 242 aa, Artificial Sequence; identical to SEQ ID NO: 4574
  Synthetic Polypeptide encoding a scFv fragment

SEQ ID NO: 11173 - protein, 250 aa, Artificial Sequence; identical to SEQ ID NO: 4575
  Synthetic Polypeptide encoding a scFv fragment

SEQ ID NO: 11174 - protein, 246 aa, Artificial Sequence; identical to SEQ ID NO: 4576
  Synthetic Polypeptide encoding a scFv fragment

SEQ ID NO: 11175 - protein, 244 aa, Artificial Sequence; identical to SEQ ID NO: 4577
  Synthetic Polypeptide encoding a scFv fragment

SEQ ID NO: 11176 - protein, 244 aa, Artificial Sequence; identical to SEQ ID NO: 4578
  Synthetic Polypeptide encoding a scFv fragment

SEQ ID NO: 11177 - protein, 245 aa, Artificial Sequence; identical to SEQ ID NO: 4579
  Synthetic Polypeptide encoding a scFv fragment

SEQ ID NO: 11178 - protein, 243 aa, Artificial Sequence; identical to SEQ ID NO: 4580
  Synthetic Polypeptide encoding a scFv fragment

SEQ ID NO: 11179 - protein, 245 aa, Artificial Sequence; identical to SEQ ID NO: 4584
  Synthetic Polypeptide encoding a scFv fragment

SEQ ID NO: 11180 - protein, 245 aa, Artificial Sequence; identical to SEQ ID NO: 4585
  Synthetic Polypeptide encoding a scFv fragment

SEQ ID NO: 11181 - protein, 245 aa, Artificial Sequence; identical to SEQ ID NO: 4585
  Synthetic Polypeptide encoding a scFv fragment

SEQ ID NO: 11182 - protein, 244 aa, Artificial Sequence; identical to SEQ ID NO: 4587
  Synthetic Polypeptide encoding a scFv fragment

SEQ ID NO: 11183 - protein, 247 aa, Artificial Sequence; identical to SEQ ID NO: 4588
  Synthetic Polypeptide encoding a scFv fragment

SEQ ID NO: 11184 - protein, 248 aa, Artificial Sequence; identical to SEQ ID NO: 4589
  Synthetic Polypeptide encoding a scFv fragment

SEQ ID NO: 11185 - protein, 240 aa, Artificial Sequence; identical to SEQ ID NO: 4602
  Synthetic Polypeptide encoding a scFv fragment

SEQ ID NO: 11186 - protein, 246 aa, Artificial Sequence; identical to SEQ ID NO: 4603
  Synthetic Polypeptide encoding a scFv fragment

SEQ ID NO: 11187 - protein, 239 aa, Artificial Sequence; identical to SEQ ID NO: 4605
  Synthetic Polypeptide encoding a scFv fragment

SEQ ID NO: 11188 - protein, 243 aa, Artificial Sequence; identical to SEQ ID NO: 4606
  Synthetic Polypeptide encoding a scFv fragment

SEQ ID NO: 11189 - protein, 241 aa, Artificial Sequence; identical to SEQ ID NO: 4607
  Synthetic Polypeptide encoding a scFv fragment

SEQ ID NO: 11190 - protein, 250 aa, Artificial Sequence; identical to SEQ ID NO: 4608
  Synthetic Polypeptide encoding a scFv fragment

SEQ ID NO: 11191 - protein, 246 aa, Artificial Sequence; identical to SEQ ID NO: 4609
  Synthetic Polypeptide encoding a scFv fragment

SEQ ID NO: 11192 - protein, 250 aa, Artificial Sequence; identical to SEQ ID NO: 4616
  Synthetic Polypeptide encoding a scFv fragment

SEQ ID NO: 11193 - protein, 236 aa, Artificial Sequence; identical to SEQ ID NO: 4617
  Synthetic Polypeptide encoding a scFv fragment

SEQ ID NO: 11194 - protein, 245 aa, Artificial Sequence; identical to SEQ ID NO: 4618
  Synthetic Polypeptide encoding a scFv fragment

SEQ ID NO: 11195 - protein, 241 aa, Artificial Sequence; identical to SEQ ID NO: 4619
  Synthetic Polypeptide encoding a scFv fragment

SEQ ID NO: 11196 - protein, 249 aa, Artificial Sequence; identical to SEQ ID NO: 4621
  Synthetic Polypeptide encoding a scFv fragment

SEQ ID NO: 11197 - protein, 244 aa, Artificial Sequence; identical to SEQ ID NO: 4634
  Synthetic Polypeptide encoding a scFv fragment

SEQ ID NO: 11198 - protein, 239 aa, Artificial Sequence; identical to SEQ ID NO: 4635
  Synthetic Polypeptide encoding a scFv fragment

SEQ ID NO: 11199 - protein, 242 aa, Artificial Sequence; identical to SEQ ID NO: 4636
  Synthetic Polypeptide encoding a scFv fragment

SEQ ID NO: 11200 - protein, 237 aa, Artificial Sequence; identical to SEQ ID NO: 4637
  Synthetic Polypeptide encoding a scFv fragment

SEQ ID NO: 11201 - protein, 247 aa, Artificial Sequence; identical to SEQ ID NO: 4638
  Synthetic Polypeptide encoding a scFv fragment

SEQ ID NO: 11202 - protein, 239 aa, Artificial Sequence; identical to SEQ ID NO: 4639
  Synthetic Polypeptide encoding a scFv fragment

SEQ ID NO: 11203 - protein, 242 aa, Artificial Sequence; identical to SEQ ID NO: 4640
  Synthetic Polypeptide encoding a scFv fragment

SEQ ID NO: 11204 - protein, 252 aa, Artificial Sequence; identical to SEQ ID NO: 4641
  Synthetic Polypeptide encoding a scFv fragment

SEQ ID NO: 11205 - protein, 249 aa, Artificial Sequence; identical to SEQ ID NO: 4642
  Synthetic Polypeptide encoding a scFv fragment

SEQ ID NO: 11206 - protein, 241 aa, Artificial Sequence; identical to SEQ ID NO: 4643
  Synthetic Polypeptide encoding a scFv fragment

SEQ ID NO: 11207 - protein, 234 aa, Artificial Sequence; identical to SEQ ID NO: 4644
  Synthetic Polypeptide encoding a scFv fragment

SEQ ID NO: 11208 - protein, 239 aa, Artificial Sequence; identical to SEQ ID NO: 4645
  Synthetic Polypeptide encoding a scFv fragment

SEQ ID NO: 11209 - protein, 242 aa, Artificial Sequence; identical to SEQ ID NO: 4646
  Synthetic Polypeptide encoding a scFv fragment

SEQ ID NO: 11210 - protein, 247 aa, Artificial Sequence; identical to SEQ ID NO: 4647
  Synthetic Polypeptide encoding a scFv fragment

SEQ ID NO: 11211 - protein, 258 aa, Artificial Sequence; identical to SEQ ID NO: 4652
  Synthetic Polypeptide encoding a scFv fragment

SEQ ID NO: 11212 - protein, 244 aa, Artificial Sequence; identical to SEQ ID NO: 4653
  Synthetic Polypeptide encoding a scFv fragment

SEQ ID NO: 11213 - protein, 241 aa, Artificial Sequence; identical to SEQ ID NO: 4654
  Synthetic Polypeptide encoding a scFv fragment

SEQ ID NO: 11214 - protein, 242 aa, Artificial Sequence; identical to SEQ ID NO: 4655
  Synthetic Polypeptide encoding a scFv fragment

SEQ ID NO: 11215 - protein, 248 aa, Artificial Sequence; identical to SEQ ID NO: 4662
  Synthetic Polypeptide encoding a scFv fragment

SEQ ID NO: 11216 - protein, 248 aa, Artificial Sequence; identical to SEQ ID NO: 4663
  Synthetic Polypeptide encoding a scFv fragment

SEQ ID NO: 11217 - protein, 246 aa, Artificial Sequence; identical to SEQ ID NO: 4664
  Synthetic Polypeptide encoding a scFv fragment

SEQ ID NO: 11218 - protein, 241 aa, Artificial Sequence; identical to SEQ ID NO: 4665
  Synthetic Polypeptide encoding a scFv fragment

SEQ ID NO: 11219 - protein, 241 aa, Artificial Sequence; identical to SEQ ID NO: 4666
  Synthetic Polypeptide encoding a scFv fragment

SEQ ID NO: 11220 - protein, 245 aa, Artificial Sequence; identical to SEQ ID NO: 4667
  Synthetic Polypeptide encoding a scFv fragment

SEQ ID NO: 11221 - protein, 236 aa, Artificial Sequence; identical to SEQ ID NO: 4668
  Synthetic Polypeptide encoding a scFv fragment

SEQ ID NO: 11222 - protein, 241 aa, Artificial Sequence; identical to SEQ ID NO: 4669
  Synthetic Polypeptide encoding a scFv fragment

SEQ ID NO: 11223 - protein, 248 aa, Artificial Sequence; identical to SEQ ID NO: 4670
  Synthetic Polypeptide encoding a scFv fragment

SEQ ID NO: 11224 - protein, 249 aa, Artificial Sequence; identical to SEQ ID NO: 4671
  Synthetic Polypeptide encoding a scFv fragment

SEQ ID NO: 11225 - protein, 246 aa, Artificial Sequence; identical to SEQ ID NO: 4672
  Synthetic Polypeptide encoding a scFv fragment

SEQ ID NO: 11226 - protein, 244 aa, Artificial Sequence; identical to SEQ ID NO: 4673
  Synthetic Polypeptide encoding a scFv fragment

SEQ ID NO: 11227 - protein, 246 aa, Artificial Sequence; identical to SEQ ID NO: 4676
  Synthetic Polypeptide encoding a scFv fragment

SEQ ID NO: 11228 - protein, 245 aa, Artificial Sequence; identical to SEQ ID NO: 4677
  Synthetic Polypeptide encoding a scFv fragment

SEQ ID NO: 11229 - protein, 249 aa, Artificial Sequence; identical to SEQ ID NO: 4678
  Synthetic Polypeptide encoding a scFv fragment

SEQ ID NO: 11230 - protein, 241 aa, Artificial Sequence; identical to SEQ ID NO: 4679
  Synthetic Polypeptide encoding a scFv fragment

SEQ ID NO: 11231 - protein, 239 aa, Artificial Sequence; identical to SEQ ID NO: 4680
  Synthetic Polypeptide encoding a scFv fragment

SEQ ID NO: 11232 - protein, 242 aa, Artificial Sequence; identical to SEQ ID NO: 4681
  Synthetic Polypeptide encoding a scFv fragment

SEQ ID NO: 11233 - protein, 244 aa, Artificial Sequence; identical to SEQ ID NO: 4682
  Synthetic Polypeptide encoding a scFv fragment

SEQ ID NO: 11234 - protein, 249 aa, Artificial Sequence; identical to SEQ ID NO: 4683
  Synthetic Polypeptide encoding a scFv fragment

SEQ ID NO: 11235 - protein, 243 aa, Artificial Sequence; identical to SEQ ID NO: 4684
  Synthetic Polypeptide encoding a scFv fragment

SEQ ID NO: 11236 - protein, 244 aa, Artificial Sequence; identical to SEQ ID NO: 4685
  Synthetic Polypeptide encoding a scFv fragment

SEQ ID NO: 11237 - protein, 243 aa, Artificial Sequence; identical to SEQ ID NO: 4686
  Synthetic Polypeptide encoding a scFv fragment

SEQ ID NO: 11238 - protein, 242 aa, Artificial Sequence; identical to SEQ ID NO: 4687
  Synthetic Polypeptide encoding a scFv fragment

SEQ ID NO: 11239 - protein, 242 aa, Artificial Sequence; identical to SEQ ID NO: 4690
  Synthetic Polypeptide encoding a scFv fragment

SEQ ID NO: 11240 - protein, 252 aa, Artificial Sequence; identical to SEQ ID NO: 4691
  Synthetic Polypeptide encoding a scFv fragment

SEQ ID NO: 11241 - protein, 242 aa, Artificial Sequence; identical to SEQ ID NO: 4692
  Synthetic Polypeptide encoding a scFv fragment

SEQ ID NO: 11242 - protein, 241 aa, Artificial Sequence; identical to SEQ ID NO: 4693
  Synthetic Polypeptide encoding a scFv fragment

SEQ ID NO: 11243 - protein, 242 aa, Artificial Sequence; identical to SEQ ID NO: 4694
  Synthetic Polypeptide encoding a scFv fragment

SEQ ID NO: 11244 - protein, 241 aa, Artificial Sequence; identical to SEQ ID NO: 4695
  Synthetic Polypeptide encoding a scFv fragment

SEQ ID NO: 11245 - protein, 249 aa, Artificial Sequence; identical to SEQ ID NO: 4696
  Synthetic Polypeptide encoding a scFv fragment

SEQ ID NO: 11246 - protein, 255 aa, Artificial Sequence; identical to SEQ ID NO: 4697
  Synthetic Polypeptide encoding a scFv fragment

SEQ ID NO: 11247 - protein, 240 aa, Artificial Sequence; identical to SEQ ID NO: 4698
  Synthetic Polypeptide encoding a scFv fragment

SEQ ID NO: 11248 - protein, 250 aa, Artificial Sequence; identical to SEQ ID NO: 4699
  Synthetic Polypeptide encoding a scFv fragment

SEQ ID NO: 11249 - protein, 245 aa, Artificial Sequence; identical to SEQ ID NO: 4701
  Synthetic Polypeptide encoding a scFv fragment

SEQ ID NO: 11250 - protein, 252 aa, Artificial Sequence; identical to SEQ ID NO: 4704
  Synthetic Polypeptide encoding a scFv fragment

SEQ ID NO: 11251 - protein, 246 aa, Artificial Sequence; identical to SEQ ID NO: 4705
  Synthetic Polypeptide encoding a scFv fragment

SEQ ID NO: 11252 - protein, 230 aa, Artificial Sequence; identical to SEQ ID NO: 4706
  Synthetic Polypeptide encoding a scFv fragment

SEQ ID NO: 11253 - protein, 240 aa, Artificial Sequence; identical to SEQ ID NO: 4707
  Synthetic Polypeptide encoding a scFv fragment

SEQ ID NO: 11254 - protein, 244 aa, Artificial Sequence; identical to SEQ ID NO: 4708
  Synthetic Polypeptide encoding a scFv fragment

SEQ ID NO: 11255 - protein, 250 aa, Artificial Sequence; identical to SEQ ID NO: 4709
  Synthetic Polypeptide encoding a scFv fragment

SEQ ID NO: 11256 - protein, 240 aa, Artificial Sequence; identical to SEQ ID NO: 4710
  Synthetic Polypeptide encoding a scFv fragment

SEQ ID NO: 11257 - protein, 241 aa, Artificial Sequence; identical to SEQ ID NO: 4711
  Synthetic Polypeptide encoding a scFv fragment

SEQ ID NO: 11258 - protein, 245 aa, Artificial Sequence; identical to SEQ ID NO: 4712
  Synthetic Polypeptide encoding a scFv fragment

SEQ ID NO: 11259 - protein, 240 aa, Artificial Sequence; identical to SEQ ID NO: 4713
  Synthetic Polypeptide encoding a scFv fragment

SEQ ID NO: 11260 - protein, 241 aa, Artificial Sequence; identical to SEQ ID NO: 4714
  Synthetic Polypeptide encoding a scFv fragment

SEQ ID NO: 11261 - protein, 249 aa, Artificial Sequence; identical to SEQ ID NO: 4715
  Synthetic Polypeptide encoding a scFv fragment

SEQ ID NO: 11262 - protein, 244 aa, Artificial Sequence; identical to SEQ ID NO: 4716
  Synthetic Polypeptide encoding a scFv fragment

SEQ ID NO: 11263 - protein, 251 aa, Artificial Sequence; identical to SEQ ID NO: 4717
  Synthetic Polypeptide encoding a scFv fragment

SEQ ID NO: 11264 - protein, 248 aa, Artificial Sequence; identical to SEQ ID NO: 4718
  Synthetic Polypeptide encoding a scFv fragment

SEQ ID NO: 11265 - protein, 242 aa, Artificial Sequence; identical to SEQ ID NO: 4719
  Synthetic Polypeptide encoding a scFv fragment

SEQ ID NO: 11266 - protein, 242 aa, Artificial Sequence; identical to SEQ ID NO: 4720
  Synthetic Polypeptide encoding a scFv fragment

SEQ ID NO: 11267 - protein, 240 aa, Artificial Sequence; identical to SEQ ID NO: 4721
  Synthetic Polypeptide encoding a scFv fragment

SEQ ID NO: 11268 - protein, 240 aa, Artificial Sequence; identical to SEQ ID NO: 4722
  Synthetic Polypeptide encoding a scFv fragment

SEQ ID NO: 11269 - protein, 241 aa, Artificial Sequence; identical to SEQ ID NO: 4723
  Synthetic Polypeptide encoding a scFv fragment

SEQ ID NO: 11270 - protein, 242 aa, Artificial Sequence; identical to SEQ ID NO: 4724
  Synthetic Polypeptide encoding a scFv fragment

SEQ ID NO: 11271 - protein, 241 aa, Artificial Sequence; identical to SEQ ID NO: 4725
  Synthetic Polypeptide encoding a scFv fragment

SEQ ID NO: 11272 - protein, 244 aa, Artificial Sequence; identical to SEQ ID NO: 4726
  Synthetic Polypeptide encoding a scFv fragment

SEQ ID NO: 11273 - protein, 245 aa, Artificial Sequence; identical to SEQ ID NO: 4727
  Synthetic Polypeptide encoding a scFv fragment

SEQ ID NO: 11274 - protein, 244 aa, Artificial Sequence; identical to SEQ ID NO: 4728
  Synthetic Polypeptide encoding a scFv fragment

SEQ ID NO: 11275 - protein, 247 aa, Artificial Sequence; identical to SEQ ID NO: 4729
  Synthetic Polypeptide encoding a scFv fragment

SEQ ID NO: 11276 - protein, 250 aa, Artificial Sequence; identical to SEQ ID NO: 4730
  Synthetic Polypeptide encoding a scFv fragment

SEQ ID NO: 11277 - protein, 249 aa, Artificial Sequence; identical to SEQ ID NO: 4731
  Synthetic Polypeptide encoding a scFv fragment

SEQ ID NO: 11278 - protein, 239 aa, Artificial Sequence; identical to SEQ ID NO: 4732
  Synthetic Polypeptide encoding a scFv fragment

SEQ ID NO: 11279 - protein, 241 aa, Artificial Sequence; identical to SEQ ID NO: 4733
  Synthetic Polypeptide encoding a scFv fragment

SEQ ID NO: 11280 - protein, 245 aa, Artificial Sequence; identical to SEQ ID NO: 4734
  Synthetic Polypeptide encoding a scFv fragment

SEQ ID NO: 11281 - protein, 244 aa, Artificial Sequence; identical to SEQ ID NO: 4735
  Synthetic Polypeptide encoding a scFv fragment

SEQ ID NO: 11282 - protein, 241 aa, Artificial Sequence; identical to SEQ ID NO: 4736
  Synthetic Polypeptide encoding a scFv fragment

SEQ ID NO: 11283 - protein, 242 aa, Artificial Sequence; identical to SEQ ID NO: 4737
  Synthetic Polypeptide encoding a scFv fragment

SEQ ID NO: 11284 - protein, 240 aa, Artificial Sequence; identical to SEQ ID NO: 4738
  Synthetic Polypeptide encoding a scFv fragment

SEQ ID NO: 11285 - protein, 258 aa, Artificial Sequence; identical to SEQ ID NO: 4739
  Synthetic Polypeptide encoding a scFv fragment

SEQ ID NO: 11286 - protein, 255 aa, Artificial Sequence; identical to SEQ ID NO: 4740
  Synthetic Polypeptide encoding a scFv fragment

SEQ ID NO: 11287 - protein, 230 aa, Artificial Sequence; identical to SEQ ID NO: 4741
  Synthetic Polypeptide encoding a scFv fragment

SEQ ID NO: 11288 - protein, 245 aa, Artificial Sequence; identical to SEQ ID NO: 4742
  Synthetic Polypeptide encoding a scFv fragment

SEQ ID NO: 11289 - protein, 237 aa, Artificial Sequence; identical to SEQ ID NO: 4743
  Synthetic Polypeptide encoding a scFv fragment

SEQ ID NO: 11290 - protein, 238 aa, Artificial Sequence; identical to SEQ ID NO: 4744
  Synthetic Polypeptide encoding a scFv fragment

SEQ ID NO: 11291 - protein, 238 aa, Artificial Sequence; identical to SEQ ID NO: 4745
  Synthetic Polypeptide encoding a scFv fragment

SEQ ID NO: 11292 - protein, 241 aa, Artificial Sequence; identical to SEQ ID NO: 4746
  Synthetic Polypeptide encoding a scFv fragment

SEQ ID NO: 11293 - protein, 243 aa, Artificial Sequence; identical to SEQ ID NO: 4747
  Synthetic Polypeptide encoding a scFv fragment

SEQ ID NO: 11294 - protein, 274 aa, Artificial Sequence; identical to SEQ ID NO: 4748
  Synthetic Polypeptide encoding a scFv fragment

SEQ ID NO: 11295 - protein, 249 aa, Artificial Sequence; identical to SEQ ID NO: 4749
  Synthetic Polypeptide encoding a scFv fragment

SEQ ID NO: 11296 - protein, 245 aa, Artificial Sequence; identical to SEQ ID NO: 4750
  Synthetic Polypeptide encoding a scFv fragment

SEQ ID NO: 11297 - protein, 240 aa, Artificial Sequence; identical to SEQ ID NO: 4751
  Synthetic Polypeptide encoding a scFv fragment

SEQ ID NO: 11298 - protein, 243 aa, Artificial Sequence; identical to SEQ ID NO: 4752
  Synthetic Polypeptide encoding a scFv fragment

SEQ ID NO: 11299 - protein, 252 aa, Artificial Sequence; identical to SEQ ID NO: 4753
  Synthetic Polypeptide encoding a scFv fragment

SEQ ID NO: 11300 - protein, 243 aa, Artificial Sequence; identical to SEQ ID NO: 4754
  Synthetic Polypeptide encoding a scFv fragment

SEQ ID NO: 11301 - protein, 246 aa, Artificial Sequence; identical to SEQ ID NO: 4755
  Synthetic Polypeptide encoding a scFv fragment

SEQ ID NO: 11302 - protein, 242 aa, Artificial Sequence; identical to SEQ ID NO: 4756
  Synthetic Polypeptide encoding a scFv fragment

SEQ ID NO: 11303 - protein, 242 aa, Artificial Sequence; identical to SEQ ID NO: 4757
  Synthetic Polypeptide encoding a scFv fragment

SEQ ID NO: 11304 - protein, 247 aa, Artificial Sequence; identical to SEQ ID NO: 4758
  Synthetic Polypeptide encoding a scFv fragment

SEQ ID NO: 11305 - protein, 243 aa, Artificial Sequence; identical to SEQ ID NO: 4760
  Synthetic Polypeptide encoding a scFv fragment

SEQ ID NO: 11306 - protein, 252 aa, Artificial Sequence; identical to SEQ ID NO: 4761
  Synthetic Polypeptide encoding a scFv fragment

SEQ ID NO: 11307 - protein, 242 aa, Artificial Sequence; identical to SEQ ID NO: 4762
  Synthetic Polypeptide encoding a scFv fragment

SEQ ID NO: 11308 - protein, 239 aa, Artificial Sequence; identical to SEQ ID NO: 4763
  Synthetic Polypeptide encoding a scFv fragment

SEQ ID NO: 11309 - protein, 244 aa, Artificial Sequence; identical to SEQ ID NO: 4764
  Synthetic Polypeptide encoding a scFv fragment

SEQ ID NO: 11310 - protein, 243 aa, Artificial Sequence; identical to SEQ ID NO: 4765
  Synthetic Polypeptide encoding a scFv fragment

SEQ ID NO: 11311 - protein, 245 aa, Artificial Sequence; identical to SEQ ID NO: 4766
  Synthetic Polypeptide encoding a scFv fragment

SEQ ID NO: 11312 - protein, 241 aa, Artificial Sequence; identical to SEQ ID NO: 4767
  Synthetic Polypeptide encoding a scFv fragment

SEQ ID NO: 11313 - protein, 239 aa, Artificial Sequence; identical to SEQ ID NO: 4768
  Synthetic Polypeptide encoding a scFv fragment

SEQ ID NO: 11314 - protein, 250 aa, Artificial Sequence; identical to SEQ ID NO: 4769
  Synthetic Polypeptide encoding a scFv fragment

SEQ ID NO: 11315 - protein, 245 aa, Artificial Sequence; identical to SEQ ID NO: 4770
  Synthetic Polypeptide encoding a scFv fragment

SEQ ID NO: 11316 - protein, 249 aa, Artificial Sequence; identical to SEQ ID NO: 4771
  Synthetic Polypeptide encoding a scFv fragment

SEQ ID NO: 11317 - protein, 247 aa, Artificial Sequence; identical to SEQ ID NO: 4772
  Synthetic Polypeptide encoding a scFv fragment

SEQ ID NO: 11318 - protein, 251 aa, Artificial Sequence; identical to SEQ ID NO: 4773
  Synthetic Polypeptide encoding a scFv fragment

SEQ ID NO: 11319 - protein, 245 aa, Artificial Sequence; identical to SEQ ID NO: 4774
  Synthetic Polypeptide encoding a scFv fragment

SEQ ID NO: 11320 - protein, 245 aa, Artificial Sequence; identical to SEQ ID NO: 4775
  Synthetic Polypeptide encoding a scFv fragment

SEQ ID NO: 11321 - protein, 245 aa, Artificial Sequence; identical to SEQ ID NO: 4776
  Synthetic Polypeptide encoding a scFv fragment

SEQ ID NO: 11322 - protein, 246 aa, Artificial Sequence; identical to SEQ ID NO: 4777
  Synthetic Polypeptide encoding a scFv fragment

SEQ ID NO: 11323 - protein, 240 aa, Artificial Sequence; identical to SEQ ID NO: 4778
  Synthetic Polypeptide encoding a scFv fragment

SEQ ID NO: 11324 - protein, 244 aa, Artificial Sequence; identical to SEQ ID NO: 4622
  Synthetic Polypeptide encoding a scFv fragment

SEQ ID NO: 11325 - protein, 242 aa, Artificial Sequence; identical to SEQ ID NO: 4779
  Synthetic Polypeptide encoding a scFv fragment

SEQ ID NO: 11326 - protein, 241 aa, Artificial Sequence; identical to SEQ ID NO: 4780
  Synthetic Polypeptide encoding a scFv fragment

SEQ ID NO: 11327 - protein, 243 aa, Artificial Sequence; identical to SEQ ID NO: 4781
  Synthetic Polypeptide encoding a scFv fragment

SEQ ID NO: 11328 - protein, 234 aa, Artificial Sequence; identical to SEQ ID NO: 4782
  Synthetic Polypeptide encoding a scFv fragment

SEQ ID NO: 11329 - protein, 237 aa, Artificial Sequence; identical to SEQ ID NO: 4783
  Synthetic Polypeptide encoding a scFv fragment

SEQ ID NO: 11330 - protein, 244 aa, Artificial Sequence; identical to SEQ ID NO: 4784
  Synthetic Polypeptide encoding a scFv fragment

SEQ ID NO: 11331 - protein, 248 aa, Artificial Sequence; identical to SEQ ID NO: 4785
  Synthetic Polypeptide encoding a scFv fragment

SEQ ID NO: 11332 - protein, 240 aa, Artificial Sequence; identical to SEQ ID NO: 4786
  Synthetic Polypeptide encoding a scFv fragment

SEQ ID NO: 11333 - protein, 241 aa, Artificial Sequence; identical to SEQ ID NO: 4787
  Synthetic Polypeptide encoding a scFv fragment

SEQ ID NO: 11334 - protein, 242 aa, Artificial Sequence; identical to SEQ ID NO: 4788
  Synthetic Polypeptide encoding a scFv fragment

SEQ ID NO: 11335 - protein, 247 aa, Artificial Sequence; identical to SEQ ID NO: 4789
  Synthetic Polypeptide encoding a scFv fragment

SEQ ID NO: 11336 - protein, 244 aa, Artificial Sequence; identical to SEQ ID NO: 4790
  Synthetic Polypeptide encoding a scFv fragment

SEQ ID NO: 11337 - protein, 253 aa, Artificial Sequence; identical to SEQ ID NO: 4791
  Synthetic Polypeptide encoding a scFv fragment

SEQ ID NO: 11338 - protein, 249 aa, Artificial Sequence; identical to SEQ ID NO: 4792
  Synthetic Polypeptide encoding a scFv fragment

SEQ ID NO: 11339 - protein, 234 aa, Artificial Sequence; identical to SEQ ID NO: 4793
  Synthetic Polypeptide encoding a scFv fragment

SEQ ID NO: 11340 - protein, 253 aa, Artificial Sequence; identical to SEQ ID NO: 4794
  Synthetic Polypeptide encoding a scFv fragment

SEQ ID NO: 11341 - protein, 243 aa, Artificial Sequence; identical to SEQ ID NO: 4795
  Synthetic Polypeptide encoding a scFv fragment

SEQ ID NO: 11342 - protein, 246 aa, Artificial Sequence; identical to SEQ ID NO: 4796
  Synthetic Polypeptide encoding a scFv fragment

SEQ ID NO: 11343 - protein, 238 aa, Artificial Sequence; identical to SEQ ID NO: 4797
  Synthetic Polypeptide encoding a scFv fragment

SEQ ID NO: 11344 - protein, 246 aa, Artificial Sequence; identical to SEQ ID NO: 4798
  Synthetic Polypeptide encoding a scFv fragment

SEQ ID NO: 11345 - protein, 244 aa, Artificial Sequence; identical to SEQ ID NO: 4799
  Synthetic Polypeptide encoding a scFv fragment

SEQ ID NO: 11346 - protein, 249 aa, Artificial Sequence; identical to SEQ ID NO: 4800
  Synthetic Polypeptide encoding a scFv fragment

SEQ ID NO: 11347 - protein, 243 aa, Artificial Sequence; identical to SEQ ID NO: 4801
  Synthetic Polypeptide encoding a scFv fragment

SEQ ID NO: 11348 - protein, 247 aa, Artificial Sequence; identical to SEQ ID NO: 4802
  Synthetic Polypeptide encoding a scFv fragment

SEQ ID NO: 11349 - protein, 246 aa, Artificial Sequence; identical to SEQ ID NO: 4803
  Synthetic Polypeptide encoding a scFv fragment

SEQ ID NO: 11350 - protein, 240 aa, Artificial Sequence; identical to SEQ ID NO: 4804
  Synthetic Polypeptide encoding a scFv fragment

SEQ ID NO: 11351 - protein, 247 aa, Artificial Sequence; identical to SEQ ID NO: 4805
  Synthetic Polypeptide encoding a scFv fragment

SEQ ID NO: 11352 - protein, 245 aa, Artificial Sequence; identical to SEQ ID NO: 4806
  Synthetic Polypeptide encoding a scFv fragment

SEQ ID NO: 11353 - protein, 254 aa, Artificial Sequence; identical to SEQ ID NO: 4807
  Synthetic Polypeptide encoding a scFv fragment

SEQ ID NO: 11354 - protein, 252 aa, Artificial Sequence; identical to SEQ ID NO: 4808
  Synthetic Polypeptide encoding a scFv fragment

SEQ ID NO: 11355 - protein, 254 aa, Artificial Sequence; identical to SEQ ID NO: 4809
  Synthetic Polypeptide encoding a scFv fragment

SEQ ID NO: 11356 - protein, 253 aa, Artificial Sequence; identical to SEQ ID NO: 4810
  Synthetic Polypeptide encoding a scFv fragment

SEQ ID NO: 11357 - protein, 242 aa, Artificial Sequence; identical to SEQ ID NO: 4811
  Synthetic Polypeptide encoding a scFv fragment

SEQ ID NO: 11358 - protein, 244 aa, Artificial Sequence; identical to SEQ ID NO: 4812
  Synthetic Polypeptide encoding a scFv fragment

SEQ ID NO: 11359 - protein, 240 aa, Artificial Sequence; identical to SEQ ID NO: 4813
  Synthetic Polypeptide encoding a scFv fragment

SEQ ID NO: 11360 - protein, 245 aa, Artificial Sequence; identical to SEQ ID NO: 4814
  Synthetic Polypeptide encoding a scFv fragment

SEQ ID NO: 11361 - protein, 243 aa, Artificial Sequence; identical to SEQ ID NO: 4815
  Synthetic Polypeptide encoding a scFv fragment

SEQ ID NO: 11362 - protein, 238 aa, Artificial Sequence
  Synthetic Polypeptide encoding a scFv fragment
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIK

SEQ ID NO: 11363 - protein, 239 aa, Artificial Sequence
  Synthetic Polypeptide encoding a scFv fragment
DIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRGGGGSGGGGSGGGGSAVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSS

SEQ ID NO: 11364 - protein, 243 aa, Artificial Sequence
  Synthetic Polypeptide encoding a scFv fragment
EIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSS

SEQ ID NO: 11365 - protein, 243 aa, Artificial Sequence
  Synthetic Polypeptide encoding a scFv fragment
EVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIK

SEQ ID NO: 11366 - protein, 243 aa, Artificial Sequence
  Synthetic Polypeptide encoding a scFv fragment
EVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIK

SEQ ID NO: 11367 - protein, 243 aa, Artificial Sequence
  Synthetic Polypeptide encoding a scFv fragment
EIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSS

SEQ ID NO: 11368 - protein, 243 aa, Artificial Sequence
  Synthetic Polypeptide encoding a scFv fragment
EIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSS

SEQ ID NO: 11369 - protein, 244 aa, Artificial Sequence
  Synthetic Polypeptide encoding a scFv fragment
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 11370 - protein, 241 aa, Artificial Sequence
  Synthetic Polypeptide encoding a scFv fragment
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 11371 - protein, 243 aa, Artificial Sequence
  Synthetic Polypeptide encoding a scFv fragment
EIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSS

SEQ ID NO: 11372 - protein, 243 aa, Artificial Sequence
  Synthetic Polypeptide encoding a scFv fragment
EIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSS

SEQ ID NO: 11373 - protein, 244 aa, Artificial Sequence
  Synthetic Polypeptide encoding a scFv fragment
QSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSA

SEQ ID NO: 11374 - protein, 243 aa, Artificial Sequence
  Synthetic Polypeptide encoding a scFv fragment
QSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSA

SEQ ID NO: 11375 - protein, 244 aa, Artificial Sequence
  Synthetic Polypeptide encoding a scFv fragment
QCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPA

SEQ ID NO: 11376 - protein, 235 aa, Artificial Sequence
  Synthetic Polypeptide encoding a scFv fragment
YVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSA

SEQ ID NO: 11377 - protein, 235 aa, Artificial Sequence; identical to SEQ ID NO: 11376
  Synthetic Polypeptide encoding a scFv fragment

SEQ ID NO: 11378 - protein, 237 aa, Artificial Sequence
  Synthetic Polypeptide encoding a scFv fragment
ASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSP

SEQ ID NO: 11379 - protein, 235 aa, Artificial Sequence
  Synthetic Polypeptide encoding a scFv fragment
YIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTS

SEQ ID NO: 11380 - protein, 235 aa, Artificial Sequence
  Synthetic Polypeptide encoding a scFv fragment
YIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTS

SEQ ID NO: 11381 - protein, 253 aa, Artificial Sequence
  Synthetic Polypeptide encoding a scFv fragment
ENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSS

SEQ ID NO: 11382 - protein, 253 aa, Artificial Sequence
  Synthetic Polypeptide encoding a scFv fragment
ENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSS

SEQ ID NO: 11383 - protein, 240 aa, Artificial Sequence
  Synthetic Polypeptide encoding a scFv fragment
EIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSS

SEQ ID NO: 11384 - protein, 255 aa, Artificial Sequence
  Synthetic Polypeptide encoding a scFv fragment
EILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSS

SEQ ID NO: 11385 - protein, 254 aa, Artificial Sequence
  Synthetic Polypeptide encoding a scFv fragment
EIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCL

SEQ ID NO: 11386 - protein, 254 aa, Artificial Sequence
  Synthetic Polypeptide encoding a scFv fragment
EIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSS

SEQ ID NO: 11387 - protein, 254 aa, Artificial Sequence
  Synthetic Polypeptide encoding a scFv fragment
EIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSS

SEQ ID NO: 11388 - protein, 254 aa, Artificial Sequence
  Synthetic Polypeptide encoding a scFv fragment
EIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSS

SEQ ID NO: 11389 - protein, 255 aa, Artificial Sequence
  Synthetic Polypeptide encoding a scFv fragment
EIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSS

SEQ ID NO: 11390 - protein, 248 aa, Artificial Sequence
  Synthetic Polypeptide encoding a scFv fragment
SFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSS

SEQ ID NO: 11391 - protein, 248 aa, Artificial Sequence
  Synthetic Polypeptide encoding a scFv fragment
SFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSS

SEQ ID NO: 11392 - protein, 240 aa, Artificial Sequence
  Synthetic Polypeptide encoding a scFv fragment
DIQMTQSPSSLSASVGDRVTITCRASVNIYSYLAWYQQKPGKAPKLLIYNAKILAEGVPSRFSGSGSGTDFTLTISSLQPEDFATYYCQHHYGTFTFGGGTKVEIKRGGGGSGGGGSGGGGSQVQLVESGGGVVQPGRSLRLSCAASGFSLTSYGVHWVRQAPGKGLEWVAVIWSDGSTTYNSALKSRFTISRDNSKNTLYLQMNSLRADDTAVYYCARHYGSTLAFASWGQGTLVTVSS

SEQ ID NO: 11393 - protein, 248 aa, Artificial Sequence
  Synthetic Polypeptide encoding a scFv fragment
EIVLTQSPGTLSLSPGERATLSCKASQNVGNNVAWYQQKPGQAPRLLIYSASYRYSGIPDRFSGSGSGTDFTLTISRLEPEDFAVYYCQQYNTYPFTFGQGTRLEIKRGGGGSGGGGSGGGGSEVQLVESGGGLVQPGGSLRLSCAASGFTFSNYWMNWVRQAPGKGLEWVAEIRFKSHNYATHFAESVKGRFTISRDNAKNSLYLQMNSLRVEDTAVYYCVRRIGNSDYDWWYFDVWGRGTLVTVSS

SEQ ID NO: 11394 - protein, 245 aa, Artificial Sequence
  Synthetic Polypeptide encoding a scFv fragment
DIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11395 - protein, 245 aa, Artificial Sequence
  Synthetic Polypeptide encoding a scFv fragment
DIVLTQSPASLAVSLGERATINCRASESVSVIGAHLIHWYQQKPGQPPKLLIYLASNLETGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11396 - protein, 245 aa, Artificial Sequence
  Synthetic Polypeptide encoding a scFv fragment
DIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11397 - protein, 244 aa, Artificial Sequence
  Synthetic Polypeptide encoding a scFv fragment
DIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11398 - protein, 244 aa, Artificial Sequence
  Synthetic Polypeptide encoding a scFv fragment
DIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11399 - protein, 244 aa, Artificial Sequence
  Synthetic Polypeptide encoding a scFv fragment
DIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11400 - protein, 244 aa, Artificial Sequence
  Synthetic Polypeptide encoding a scFv fragment
DIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSS

SEQ ID NO: 11401 - protein, 244 aa, Artificial Sequence; identical to SEQ ID NO: 4799
  Synthetic Polypeptide encoding a scFv fragment

SEQ ID NO: 11402 - protein, 503 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11403 - protein, 503 aa, Artificial Sequence
  Synthetic Polypeptide encoding a CAR and optional  accessory module(s)
MALPVTALLLPLALLLHAARPAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSAGGGGSGGGGSGGGGSQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11404 - protein, 679 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11405 - protein, 910 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11406 - protein, 898 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11407 - protein, 863 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11408 - protein, 873 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11409 - protein, 856 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11410 - protein, 848 aa, Artificial Sequence
  Synthetic Polypeptide encoding a CAR and optional  accessory module(s)
MALPVTALLLPLALLLHAARPAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSAGGGGSGGGGSGGGGSQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11411 - protein, 863 aa, Artificial Sequence
  Synthetic Polypeptide encoding a CAR and optional  accessory module(s)
MALPVTALLLPLALLLHAARPAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSAGGGGSGGGGSGGGGSQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11412 - protein, 873 aa, Artificial Sequence
  Synthetic Polypeptide encoding a CAR and optional  accessory module(s)
MALPVTALLLPLALLLHAARPAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSAGGGGSGGGGSGGGGSQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11413 - protein, 856 aa, Artificial Sequence
  Synthetic Polypeptide encoding a CAR and optional  accessory module(s)
MALPVTALLLPLALLLHAARPAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSAGGGGSGGGGSGGGGSQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11414 - protein, 622 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11415 - protein, 626 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11416 - protein, 637 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11417 - protein, 636 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11418 - protein, 632 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11419 - protein, 653 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11420 - protein, 1075 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11421 - protein, 1076 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11422 - protein, 1129 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11423 - protein, 1079 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11424 - protein, 1075 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11425 - protein, 893 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11426 - protein, 1237 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11427 - protein, 1076 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11428 - protein, 1401 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11429 - protein, 1068 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11430 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11431 - protein, 652 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11432 - protein, 622 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11433 - protein, 704 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11434 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGGGGGSGGGGSGGGGSAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11435 - protein, 659 aa, Artificial Sequence
  Synthetic Polypeptide encoding a CAR and optional  accessory module(s)
MALPVTALLLPLALLLHAARPQSALTQPRSVSASPGQSVTISCTGTHNYVSWCQQKPGQAPKLLIYDFNKRPSGVSDRFSGSTSGNTASLTISGLQADDEGHYFCWAFENIGGGTKLTVLGLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAGLMQSGAVMKNSGASVRVSCQADGYDFIDYVIHWFRQRRGEGLEWLGWMNPSGGGTNYPRPFQGKVTMTRDTSTETAYLDVRGLTYDDTAVYYCVRDRANGSGRRRFESVNWFLDLWGRGTQITVVSATREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11436 - protein, 502 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11437 - protein, 502 aa, Artificial Sequence
  Synthetic Polypeptide encoding a CAR and optional  accessory module(s)
MALPVTALLLPLALLLHAARPADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSAGGGGSGGGGSGGGGSQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11438 - protein, 678 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11439 - protein, 909 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11440 - protein, 897 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11441 - protein, 862 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11442 - protein, 872 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11443 - protein, 855 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11444 - protein, 847 aa, Artificial Sequence
  Synthetic Polypeptide encoding a CAR and optional  accessory module(s)
MALPVTALLLPLALLLHAARPADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSAGGGGSGGGGSGGGGSQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11445 - protein, 862 aa, Artificial Sequence
  Synthetic Polypeptide encoding a CAR and optional  accessory module(s)
MALPVTALLLPLALLLHAARPADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSAGGGGSGGGGSGGGGSQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11446 - protein, 872 aa, Artificial Sequence
  Synthetic Polypeptide encoding a CAR and optional  accessory module(s)
MALPVTALLLPLALLLHAARPADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSAGGGGSGGGGSGGGGSQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11447 - protein, 855 aa, Artificial Sequence
  Synthetic Polypeptide encoding a CAR and optional  accessory module(s)
MALPVTALLLPLALLLHAARPADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSAGGGGSGGGGSGGGGSQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11448 - protein, 621 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11449 - protein, 625 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11450 - protein, 636 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11451 - protein, 635 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11452 - protein, 631 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11453 - protein, 652 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11454 - protein, 1074 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11455 - protein, 1075 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11456 - protein, 1128 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11457 - protein, 1078 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11458 - protein, 1074 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11459 - protein, 892 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11460 - protein, 1236 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11461 - protein, 1075 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11462 - protein, 1400 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11463 - protein, 1067 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11464 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11465 - protein, 651 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11466 - protein, 621 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11467 - protein, 703 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11468 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGGGGGSGGGGSGGGGSADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11469 - protein, 658 aa, Artificial Sequence
  Synthetic Polypeptide encoding a CAR and optional  accessory module(s)
MALPVTALLLPLALLLHAARPQSALTQPRSVSASPGQSVTISCTGTHNLVSWCQHQPGRAPKLLIYDFNKRPSGVPDRFSGSGSGGTASLTITGLQDDDDAEYFCWAYEAFGGGTKLTVLGLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEADLVQSGAVVKKPGDSVRISCEAQGYRFPDYIIHWIRRAPGQGPEWMGWMNPMGGQVNIPWKFQGRVSMTRDTSIETAFLDLRGLKSDDTAVYYCVRDRSNGSGKRFESSNWFLDLWGRGTAVTIQSATREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11470 - protein, 496 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11471 - protein, 496 aa, Artificial Sequence
  Synthetic Polypeptide encoding a CAR and optional  accessory module(s)
MALPVTALLLPLALLLHAARPHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPGGGGSGGGGSGGGGSASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11472 - protein, 672 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11473 - protein, 903 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11474 - protein, 891 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11475 - protein, 856 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11476 - protein, 866 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11477 - protein, 849 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11478 - protein, 841 aa, Artificial Sequence
  Synthetic Polypeptide encoding a CAR and optional  accessory module(s)
MALPVTALLLPLALLLHAARPHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPGGGGSGGGGSGGGGSASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11479 - protein, 856 aa, Artificial Sequence
  Synthetic Polypeptide encoding a CAR and optional  accessory module(s)
MALPVTALLLPLALLLHAARPHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPGGGGSGGGGSGGGGSASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11480 - protein, 866 aa, Artificial Sequence
  Synthetic Polypeptide encoding a CAR and optional  accessory module(s)
MALPVTALLLPLALLLHAARPHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPGGGGSGGGGSGGGGSASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11481 - protein, 849 aa, Artificial Sequence
  Synthetic Polypeptide encoding a CAR and optional  accessory module(s)
MALPVTALLLPLALLLHAARPHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPGGGGSGGGGSGGGGSASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11482 - protein, 615 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11483 - protein, 619 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11484 - protein, 630 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11485 - protein, 629 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11486 - protein, 625 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11487 - protein, 646 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11488 - protein, 1068 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11489 - protein, 1069 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11490 - protein, 1122 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11491 - protein, 1072 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11492 - protein, 1068 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11493 - protein, 886 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11494 - protein, 1230 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11495 - protein, 1069 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11496 - protein, 1394 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11497 - protein, 1061 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11498 - protein, 664 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11499 - protein, 645 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11500 - protein, 615 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11501 - protein, 697 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11502 - protein, 713 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSGGGGSGGGGSGGGGSHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11503 - protein, 652 aa, Artificial Sequence
  Synthetic Polypeptide encoding a CAR and optional  accessory module(s)
MALPVTALLLPLALLLHAARPASALTQPASMSASPGQSVTISCSGTRHIISAWFQQYPGKPPKLIIFDDDKRPSGVPSRFSASRPGDTASLTISNVQPEDEATYICNTYEFFGGGTRLTVLSLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEHVQLVQSGGGVKKIGAAVRISCEVTGYKFMDQLINWVRQAPGQGLEWMGWMNPTYGQVNYSWRFEGRVTMTRDMDTETAFMELRGLRVDDTAVYYCARGPSGENYPFHYWGQGVRVVVSSPTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11504 - protein, 503 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11505 - protein, 503 aa, Artificial Sequence
  Synthetic Polypeptide encoding a CAR and optional  accessory module(s)
MALPVTALLLPLALLLHAARPSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPAGGGGSGGGGSGGGGSQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11506 - protein, 679 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11507 - protein, 910 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11508 - protein, 898 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11509 - protein, 863 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11510 - protein, 873 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11511 - protein, 856 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11512 - protein, 848 aa, Artificial Sequence
  Synthetic Polypeptide encoding a CAR and optional  accessory module(s)
MALPVTALLLPLALLLHAARPSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPAGGGGSGGGGSGGGGSQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11513 - protein, 863 aa, Artificial Sequence
  Synthetic Polypeptide encoding a CAR and optional  accessory module(s)
MALPVTALLLPLALLLHAARPSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPAGGGGSGGGGSGGGGSQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11514 - protein, 873 aa, Artificial Sequence
  Synthetic Polypeptide encoding a CAR and optional  accessory module(s)
MALPVTALLLPLALLLHAARPSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPAGGGGSGGGGSGGGGSQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11515 - protein, 856 aa, Artificial Sequence
  Synthetic Polypeptide encoding a CAR and optional  accessory module(s)
MALPVTALLLPLALLLHAARPSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPAGGGGSGGGGSGGGGSQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11516 - protein, 622 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11517 - protein, 626 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11518 - protein, 637 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11519 - protein, 636 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11520 - protein, 632 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11521 - protein, 653 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11522 - protein, 1075 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11523 - protein, 1076 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11524 - protein, 1129 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11525 - protein, 1079 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11526 - protein, 1075 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11527 - protein, 893 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11528 - protein, 1237 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11529 - protein, 1076 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11530 - protein, 1401 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11531 - protein, 1068 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11532 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11533 - protein, 652 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11534 - protein, 622 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11535 - protein, 704 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11536 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRGGGGSGGGGSGGGGSSAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11537 - protein, 659 aa, Artificial Sequence
  Synthetic Polypeptide encoding a CAR and optional  accessory module(s)
MALPVTALLLPLALLLHAARPQCVLTQPRSVSGSPGQSVTISCTGTHNYVSWCQHHPGNAPKLLLYDFDKRPSGISDRFSGSRSGNTASLTISGLQPEDEADYFCWAFEAFGGGTKVLVLRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFESAELVQSGAVVKKPGTSVKVSCQAYGYTFTDYLIHWLRQAPGQGLEWMGWMNPVYGQVNYAQNFQGRVSMTRDIYRETAFLEVRDLKTDDTGTYYCVRDTGDGSRRHFDSINWFLDLWGRGTWIRVAPATREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11538 - protein, 494 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11539 - protein, 494 aa, Artificial Sequence
  Synthetic Polypeptide encoding a CAR and optional  accessory module(s)
MALPVTALLLPLALLLHAARPQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSAGGGGSGGGGSGGGGSYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11540 - protein, 670 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11541 - protein, 901 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11542 - protein, 889 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11543 - protein, 854 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11544 - protein, 864 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11545 - protein, 847 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11546 - protein, 839 aa, Artificial Sequence
  Synthetic Polypeptide encoding a CAR and optional  accessory module(s)
MALPVTALLLPLALLLHAARPQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSAGGGGSGGGGSGGGGSYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11547 - protein, 854 aa, Artificial Sequence
  Synthetic Polypeptide encoding a CAR and optional  accessory module(s)
MALPVTALLLPLALLLHAARPQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSAGGGGSGGGGSGGGGSYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11548 - protein, 864 aa, Artificial Sequence
  Synthetic Polypeptide encoding a CAR and optional  accessory module(s)
MALPVTALLLPLALLLHAARPQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSAGGGGSGGGGSGGGGSYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11549 - protein, 847 aa, Artificial Sequence
  Synthetic Polypeptide encoding a CAR and optional  accessory module(s)
MALPVTALLLPLALLLHAARPQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSAGGGGSGGGGSGGGGSYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11550 - protein, 613 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11551 - protein, 617 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11552 - protein, 628 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11553 - protein, 627 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11554 - protein, 623 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11555 - protein, 644 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11556 - protein, 1066 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11557 - protein, 1067 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11558 - protein, 1120 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11559 - protein, 1070 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11560 - protein, 1066 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11561 - protein, 884 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11562 - protein, 1228 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11563 - protein, 1067 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11564 - protein, 1392 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11565 - protein, 1059 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11566 - protein, 662 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11567 - protein, 643 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11568 - protein, 613 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11569 - protein, 695 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11570 - protein, 711 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRGGGGSGGGGSGGGGSQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11571 - protein, 650 aa, Artificial Sequence
  Synthetic Polypeptide encoding a CAR and optional  accessory module(s)
MALPVTALLLPLALLLHAARPYVQSQSPSTLYASVGDKITITCRSSQSGWKAWYQQKPGKAPKLLIYKSSILETGVPSRFSGSDSGTEFTLTISSLQPDDFATYYCQHFETFGQGTRVQVRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIELVQSGTEVKRPGASVRISCASSGYRFTNYFIHWVRQAPGRGLEWMGWMNPLHGGVNYSGRFQGRVTMTRDIYTETSFMVLSGLTSDDTAIYFCTRGRDGYDDGFHPWGQGTLVTVSATREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11572 - protein, 494 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11573 - protein, 494 aa, Artificial Sequence
  Synthetic Polypeptide encoding a CAR and optional  accessory module(s)
MALPVTALLLPLALLLHAARPRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11574 - protein, 670 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11575 - protein, 901 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11576 - protein, 889 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11577 - protein, 854 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11578 - protein, 864 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11579 - protein, 847 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11580 - protein, 839 aa, Artificial Sequence
  Synthetic Polypeptide encoding a CAR and optional  accessory module(s)
MALPVTALLLPLALLLHAARPRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11581 - protein, 854 aa, Artificial Sequence
  Synthetic Polypeptide encoding a CAR and optional  accessory module(s)
MALPVTALLLPLALLLHAARPRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11582 - protein, 864 aa, Artificial Sequence
  Synthetic Polypeptide encoding a CAR and optional  accessory module(s)
MALPVTALLLPLALLLHAARPRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11583 - protein, 847 aa, Artificial Sequence
  Synthetic Polypeptide encoding a CAR and optional  accessory module(s)
MALPVTALLLPLALLLHAARPRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11584 - protein, 613 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11585 - protein, 617 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11586 - protein, 628 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11587 - protein, 627 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11588 - protein, 623 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11589 - protein, 644 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11590 - protein, 1066 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11591 - protein, 1067 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11592 - protein, 1120 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11593 - protein, 1070 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11594 - protein, 1066 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11595 - protein, 884 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11596 - protein, 1228 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11597 - protein, 1067 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11598 - protein, 1392 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11599 - protein, 1059 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11600 - protein, 662 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11601 - protein, 643 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11602 - protein, 613 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11603 - protein, 695 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11604 - protein, 711 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11605 - protein, 650 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERAQLVQSGPEVKKPGASVRISCAASGYTFVDSFIHWLRQAPGQGLEWIGWINPLRGGVNYSGRFQGRVAMTRNTFTETVYMDINGLTPDDTATYFCVRAPDSYDRGYDAWGQGTRVIVTSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11606 - protein, 512 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11607 - protein, 512 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11608 - protein, 688 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11609 - protein, 919 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11610 - protein, 907 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11611 - protein, 872 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11612 - protein, 882 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11613 - protein, 865 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11614 - protein, 857 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11615 - protein, 872 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11616 - protein, 882 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11617 - protein, 865 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11618 - protein, 631 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11619 - protein, 635 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11620 - protein, 646 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11621 - protein, 645 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11622 - protein, 641 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11623 - protein, 662 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11624 - protein, 1084 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11625 - protein, 1085 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11626 - protein, 1138 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11627 - protein, 1088 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11628 - protein, 1084 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11629 - protein, 902 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11630 - protein, 1246 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11631 - protein, 1085 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11632 - protein, 1410 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11633 - protein, 1077 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11634 - protein, 680 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11635 - protein, 661 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11636 - protein, 631 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11637 - protein, 713 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11638 - protein, 729 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11639 - protein, 668 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSNLAWYQQKPGQAPRLLIHGVSTRATGIPDRFSGSGSGTDFTLTISRLEPEDFAVYFCQQYAYSPATFGQGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYHNGNTYYNPSLESRVTISVDTSKNQFSLKLTSVTAADTAVYYCARNSARAGSHLLLGRDKSWFDPWGQGTLVIVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11640 - protein, 494 aa, Artificial Sequence; identical to SEQ ID NO: 11538
  Synthetic Polypeptide encoding a CAR and optional  accessory module(s)

SEQ ID NO: 11641 - protein, 494 aa, Artificial Sequence; identical to SEQ ID NO: 11539
  Synthetic Polypeptide encoding a CAR and optional  accessory module(s)

SEQ ID NO: 11642 - protein, 670 aa, Artificial Sequence; identical to SEQ ID NO: 11540
  Synthetic Polypeptide encoding a CAR and optional  accessory module(s)

SEQ ID NO: 11643 - protein, 901 aa, Artificial Sequence; identical to SEQ ID NO: 11541
  Synthetic Polypeptide encoding a CAR and optional  accessory module(s)

SEQ ID NO: 11644 - protein, 889 aa, Artificial Sequence; identical to SEQ ID NO: 11542
  Synthetic Polypeptide encoding a CAR and optional  accessory module(s)

SEQ ID NO: 11645 - protein, 854 aa, Artificial Sequence; identical to SEQ ID NO: 11543
  Synthetic Polypeptide encoding a CAR and optional  accessory module(s)

SEQ ID NO: 11646 - protein, 864 aa, Artificial Sequence; identical to SEQ ID NO: 11544
  Synthetic Polypeptide encoding a CAR and optional  accessory module(s)

SEQ ID NO: 11647 - protein, 847 aa, Artificial Sequence; identical to SEQ ID NO: 11545
  Synthetic Polypeptide encoding a CAR and optional  accessory module(s)

SEQ ID NO: 11648 - protein, 839 aa, Artificial Sequence; identical to SEQ ID NO: 11546
  Synthetic Polypeptide encoding a CAR and optional  accessory module(s)

SEQ ID NO: 11649 - protein, 854 aa, Artificial Sequence; identical to SEQ ID NO: 11547
  Synthetic Polypeptide encoding a CAR and optional  accessory module(s)

SEQ ID NO: 11650 - protein, 864 aa, Artificial Sequence; identical to SEQ ID NO: 11548
  Synthetic Polypeptide encoding a CAR and optional  accessory module(s)

SEQ ID NO: 11651 - protein, 847 aa, Artificial Sequence; identical to SEQ ID NO: 11549
  Synthetic Polypeptide encoding a CAR and optional  accessory module(s)

SEQ ID NO: 11652 - protein, 613 aa, Artificial Sequence; identical to SEQ ID NO: 11550
  Synthetic Polypeptide encoding a CAR and optional  accessory module(s)

SEQ ID NO: 11653 - protein, 617 aa, Artificial Sequence; identical to SEQ ID NO: 11551
  Synthetic Polypeptide encoding a CAR and optional  accessory module(s)

SEQ ID NO: 11654 - protein, 628 aa, Artificial Sequence; identical to SEQ ID NO: 11552
  Synthetic Polypeptide encoding a CAR and optional  accessory module(s)

SEQ ID NO: 11655 - protein, 627 aa, Artificial Sequence; identical to SEQ ID NO: 11553
  Synthetic Polypeptide encoding a CAR and optional  accessory module(s)

SEQ ID NO: 11656 - protein, 623 aa, Artificial Sequence; identical to SEQ ID NO: 11554
  Synthetic Polypeptide encoding a CAR and optional  accessory module(s)

SEQ ID NO: 11657 - protein, 644 aa, Artificial Sequence; identical to SEQ ID NO: 11555
  Synthetic Polypeptide encoding a CAR and optional  accessory module(s)

SEQ ID NO: 11658 - protein, 1066 aa, Artificial Sequence; identical to SEQ ID NO: 11556
  Synthetic Polypeptide encoding a CAR and optional  accessory module(s)

SEQ ID NO: 11659 - protein, 1067 aa, Artificial Sequence; identical to SEQ ID NO: 11557
  Synthetic Polypeptide encoding a CAR and optional  accessory module(s)

SEQ ID NO: 11660 - protein, 1120 aa, Artificial Sequence; identical to SEQ ID NO: 11558
  Synthetic Polypeptide encoding a CAR and optional  accessory module(s)

SEQ ID NO: 11661 - protein, 1070 aa, Artificial Sequence; identical to SEQ ID NO: 11559
  Synthetic Polypeptide encoding a CAR and optional  accessory module(s)

SEQ ID NO: 11662 - protein, 1066 aa, Artificial Sequence; identical to SEQ ID NO: 11560
  Synthetic Polypeptide encoding a CAR and optional  accessory module(s)

SEQ ID NO: 11663 - protein, 884 aa, Artificial Sequence; identical to SEQ ID NO: 11561
  Synthetic Polypeptide encoding a CAR and optional  accessory module(s)

SEQ ID NO: 11664 - protein, 1228 aa, Artificial Sequence; identical to SEQ ID NO: 11562
  Synthetic Polypeptide encoding a CAR and optional  accessory module(s)

SEQ ID NO: 11665 - protein, 1067 aa, Artificial Sequence; identical to SEQ ID NO: 11563
  Synthetic Polypeptide encoding a CAR and optional  accessory module(s)

SEQ ID NO: 11666 - protein, 1392 aa, Artificial Sequence; identical to SEQ ID NO: 11564
  Synthetic Polypeptide encoding a CAR and optional  accessory module(s)

SEQ ID NO: 11667 - protein, 1059 aa, Artificial Sequence; identical to SEQ ID NO: 11565
  Synthetic Polypeptide encoding a CAR and optional  accessory module(s)

SEQ ID NO: 11668 - protein, 662 aa, Artificial Sequence; identical to SEQ ID NO: 11566
  Synthetic Polypeptide encoding a CAR and optional  accessory module(s)

SEQ ID NO: 11669 - protein, 643 aa, Artificial Sequence; identical to SEQ ID NO: 11567
  Synthetic Polypeptide encoding a CAR and optional  accessory module(s)

SEQ ID NO: 11670 - protein, 613 aa, Artificial Sequence; identical to SEQ ID NO: 11568
  Synthetic Polypeptide encoding a CAR and optional  accessory module(s)

SEQ ID NO: 11671 - protein, 695 aa, Artificial Sequence; identical to SEQ ID NO: 11569
  Synthetic Polypeptide encoding a CAR and optional  accessory module(s)

SEQ ID NO: 11672 - protein, 711 aa, Artificial Sequence; identical to SEQ ID NO: 11570
  Synthetic Polypeptide encoding a CAR and optional  accessory module(s)

SEQ ID NO: 11673 - protein, 650 aa, Artificial Sequence; identical to SEQ ID NO: 11571
  Synthetic Polypeptide encoding a CAR and optional  accessory module(s)

SEQ ID NO: 11674 - protein, 499 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11675 - protein, 499 aa, Artificial Sequence
  Synthetic Polypeptide encoding a CAR and optional  accessory module(s)
MALPVTALLLPLALLLHAARPQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSGGGGSGGGGSGGGGSEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11676 - protein, 675 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11677 - protein, 906 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11678 - protein, 894 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11679 - protein, 859 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11680 - protein, 869 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11681 - protein, 852 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11682 - protein, 844 aa, Artificial Sequence
  Synthetic Polypeptide encoding a CAR and optional  accessory module(s)
MALPVTALLLPLALLLHAARPQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSGGGGSGGGGSGGGGSEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11683 - protein, 859 aa, Artificial Sequence
  Synthetic Polypeptide encoding a CAR and optional  accessory module(s)
MALPVTALLLPLALLLHAARPQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSGGGGSGGGGSGGGGSEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11684 - protein, 869 aa, Artificial Sequence
  Synthetic Polypeptide encoding a CAR and optional  accessory module(s)
MALPVTALLLPLALLLHAARPQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSGGGGSGGGGSGGGGSEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11685 - protein, 852 aa, Artificial Sequence
  Synthetic Polypeptide encoding a CAR and optional  accessory module(s)
MALPVTALLLPLALLLHAARPQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSGGGGSGGGGSGGGGSEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11686 - protein, 618 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11687 - protein, 622 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11688 - protein, 633 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11689 - protein, 632 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11690 - protein, 628 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11691 - protein, 649 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11692 - protein, 1071 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11693 - protein, 1072 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11694 - protein, 1125 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11695 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11696 - protein, 1071 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11697 - protein, 889 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11698 - protein, 1233 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11699 - protein, 1072 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11700 - protein, 1397 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11701 - protein, 1064 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11702 - protein, 667 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11703 - protein, 648 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11704 - protein, 618 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11705 - protein, 700 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11706 - protein, 716 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKGGGGSGGGGSGGGGSQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11707 - protein, 655 aa, Artificial Sequence
  Synthetic Polypeptide encoding a CAR and optional  accessory module(s)
MALPVTALLLPLALLLHAARPEIVLTQSPGTLSLSPGERATLSCRTSQTVRSSFLAWYQQKPGQAPSLLIYGTSSRATGIPDRFSGSGSGTDFTLTISGLEPEDSAVYYCQQYGSSLTFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQLQLVQSGAEVKKPGASVKVSCKASGDSVTGYYIHWVRQAPGQGLEWIGWIRPNNGGTNFPRKFQGRVTMTWDTSLTTAYMDLSGLTSDDTAVYYCVPHRWPDYFDSWGQGTLVIVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11708 - protein, 494 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11709 - protein, 494 aa, Artificial Sequence
  Synthetic Polypeptide encoding a CAR and optional  accessory module(s)
MALPVTALLLPLALLLHAARPRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11710 - protein, 670 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11711 - protein, 901 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11712 - protein, 889 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11713 - protein, 854 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11714 - protein, 864 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11715 - protein, 847 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11716 - protein, 839 aa, Artificial Sequence
  Synthetic Polypeptide encoding a CAR and optional  accessory module(s)
MALPVTALLLPLALLLHAARPRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11717 - protein, 854 aa, Artificial Sequence
  Synthetic Polypeptide encoding a CAR and optional  accessory module(s)
MALPVTALLLPLALLLHAARPRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11718 - protein, 864 aa, Artificial Sequence
  Synthetic Polypeptide encoding a CAR and optional  accessory module(s)
MALPVTALLLPLALLLHAARPRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11719 - protein, 847 aa, Artificial Sequence
  Synthetic Polypeptide encoding a CAR and optional  accessory module(s)
MALPVTALLLPLALLLHAARPRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSGGGGSGGGGSGGGGSYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11720 - protein, 613 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11721 - protein, 617 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11722 - protein, 628 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11723 - protein, 627 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11724 - protein, 623 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11725 - protein, 644 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11726 - protein, 1066 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11727 - protein, 1067 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11728 - protein, 1120 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11729 - protein, 1070 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11730 - protein, 1066 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11731 - protein, 884 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11732 - protein, 1228 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11733 - protein, 1067 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11734 - protein, 1392 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11735 - protein, 1059 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11736 - protein, 662 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11737 - protein, 643 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11738 - protein, 613 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11739 - protein, 695 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11740 - protein, 711 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKGGGGSGGGGSGGGGSRVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11741 - protein, 650 aa, Artificial Sequence
  Synthetic Polypeptide encoding a CAR and optional  accessory module(s)
MALPVTALLLPLALLLHAARPYIQVTQSPSTLSASIGDTVTITCRASEGWLAWYQQKPGKAPKLIIYKTSTLERGVPSRFSGSVSGADFTLTISGLQSDDFATYYCQKFEFFGQGTVVDMKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERVQLVQSGPEVKKPGASVRISCKASGYKFSDSLIHWLRQSPRDGLQWLGYMNPMGGAVNYAHRLQGRVQMTRDIFSETAYMDIRGLTPDDTATYFCVRDPDAYERGFDAWGQGTRIVVTSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11742 - protein, 507 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11743 - protein, 507 aa, Artificial Sequence
  Synthetic Polypeptide encoding a CAR and optional  accessory module(s)
MALPVTALLLPLALLLHAARPDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSGGGGSGGGGSGGGGSSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11744 - protein, 683 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11745 - protein, 914 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11746 - protein, 902 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11747 - protein, 867 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11748 - protein, 877 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11749 - protein, 860 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11750 - protein, 852 aa, Artificial Sequence
  Synthetic Polypeptide encoding a CAR and optional  accessory module(s)
MALPVTALLLPLALLLHAARPDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSGGGGSGGGGSGGGGSSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11751 - protein, 867 aa, Artificial Sequence
  Synthetic Polypeptide encoding a CAR and optional  accessory module(s)
MALPVTALLLPLALLLHAARPDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSGGGGSGGGGSGGGGSSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11752 - protein, 877 aa, Artificial Sequence
  Synthetic Polypeptide encoding a CAR and optional  accessory module(s)
MALPVTALLLPLALLLHAARPDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSGGGGSGGGGSGGGGSSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11753 - protein, 860 aa, Artificial Sequence
  Synthetic Polypeptide encoding a CAR and optional  accessory module(s)
MALPVTALLLPLALLLHAARPDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSGGGGSGGGGSGGGGSSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11754 - protein, 626 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11755 - protein, 630 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11756 - protein, 641 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11757 - protein, 640 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11758 - protein, 636 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11759 - protein, 657 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11760 - protein, 1079 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11761 - protein, 1080 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11762 - protein, 1133 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11763 - protein, 1083 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11764 - protein, 1079 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11765 - protein, 897 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11766 - protein, 1241 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11767 - protein, 1080 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11768 - protein, 1405 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11769 - protein, 1072 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11770 - protein, 675 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11771 - protein, 656 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11772 - protein, 626 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11773 - protein, 708 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11774 - protein, 724 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLGGGGSGGGGSGGGGSDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11775 - protein, 663 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTVIFENDRRPSGVPDRFSGSIDTSSNSASLTISGLKTEDEADYYCQSYDTTDVIFGGGTKLTVLLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLVQSGAEVKKPGESLKISCQASGYTFTDNWIAWVRQMPGKGLEWVGFTYPADSDTRYSPSFQGHVTISADKSMRTAFLEWSSLRASDTAMYYCARLGGQCTDGVCYFDHWGRGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11776 - protein, 514 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11777 - protein, 514 aa, Artificial Sequence
  Synthetic Polypeptide encoding a CAR and optional  accessory module(s)
MALPVTALLLPLALLLHAARPLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSGGGGSGGGGSGGGGSEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11778 - protein, 690 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11779 - protein, 921 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11780 - protein, 909 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11781 - protein, 874 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11782 - protein, 884 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11783 - protein, 867 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11784 - protein, 859 aa, Artificial Sequence
  Synthetic Polypeptide encoding a CAR and optional  accessory module(s)
MALPVTALLLPLALLLHAARPLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSGGGGSGGGGSGGGGSEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11785 - protein, 874 aa, Artificial Sequence
  Synthetic Polypeptide encoding a CAR and optional  accessory module(s)
MALPVTALLLPLALLLHAARPLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSGGGGSGGGGSGGGGSEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11786 - protein, 884 aa, Artificial Sequence
  Synthetic Polypeptide encoding a CAR and optional  accessory module(s)
MALPVTALLLPLALLLHAARPLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSGGGGSGGGGSGGGGSEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11787 - protein, 867 aa, Artificial Sequence
  Synthetic Polypeptide encoding a CAR and optional  accessory module(s)
MALPVTALLLPLALLLHAARPLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSGGGGSGGGGSGGGGSEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11788 - protein, 633 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11789 - protein, 637 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11790 - protein, 648 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11791 - protein, 647 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11792 - protein, 643 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11793 - protein, 664 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11794 - protein, 1086 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11795 - protein, 1087 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11796 - protein, 1140 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11797 - protein, 1090 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11798 - protein, 1086 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11799 - protein, 904 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11800 - protein, 1248 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11801 - protein, 1087 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11802 - protein, 1412 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11803 - protein, 1079 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11804 - protein, 682 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11805 - protein, 663 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11806 - protein, 633 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11807 - protein, 715 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11808 - protein, 731 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKGGGGSGGGGSGGGGSLVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11809 - protein, 670 aa, Artificial Sequence
  Synthetic Polypeptide encoding a CAR and optional  accessory module(s)
MALPVTALLLPLALLLHAARPEILLTQSPGTLSLSPGERATLSCRASQSVSTKYLAWYQQKPGQAPRLLIYGASSRATGIPDRFTGSGSGTDFTLTITRLEPEDFAVYYCQQYGRSLTFGPGTKVDLKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFELVHLVQSGAEVKKPGSSVKVSCKASGGTFSSHVINWVRQAPGQGLEWMGGIMPLLGTANYPQKFQGRVTIIADESTNTAYMELSSLRSEDTAVYFCATSSEADDYSTGFEMGEYYYDYYVDVWGTGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11810 - protein, 507 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11811 - protein, 507 aa, Artificial Sequence
  Synthetic Polypeptide encoding a CAR and optional  accessory module(s)
MALPVTALLLPLALLLHAARPDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSGGGGSGGGGSGGGGSSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11812 - protein, 683 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11813 - protein, 914 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11814 - protein, 902 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11815 - protein, 867 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11816 - protein, 877 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11817 - protein, 860 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11818 - protein, 852 aa, Artificial Sequence
  Synthetic Polypeptide encoding a CAR and optional  accessory module(s)
MALPVTALLLPLALLLHAARPDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSGGGGSGGGGSGGGGSSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11819 - protein, 867 aa, Artificial Sequence
  Synthetic Polypeptide encoding a CAR and optional  accessory module(s)
MALPVTALLLPLALLLHAARPDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSGGGGSGGGGSGGGGSSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11820 - protein, 877 aa, Artificial Sequence
  Synthetic Polypeptide encoding a CAR and optional  accessory module(s)
MALPVTALLLPLALLLHAARPDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSGGGGSGGGGSGGGGSSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11821 - protein, 860 aa, Artificial Sequence
  Synthetic Polypeptide encoding a CAR and optional  accessory module(s)
MALPVTALLLPLALLLHAARPDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSGGGGSGGGGSGGGGSSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11822 - protein, 626 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11823 - protein, 630 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11824 - protein, 641 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11825 - protein, 640 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11826 - protein, 636 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11827 - protein, 657 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11828 - protein, 1079 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11829 - protein, 1080 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11830 - protein, 1133 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11831 - protein, 1083 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11832 - protein, 1079 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11833 - protein, 897 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11834 - protein, 1241 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11835 - protein, 1080 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11836 - protein, 1405 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11837 - protein, 1072 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11838 - protein, 675 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11839 - protein, 656 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11840 - protein, 626 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11841 - protein, 708 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11842 - protein, 724 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLGGGGSGGGGSGGGGSDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11843 - protein, 663 aa, Artificial Sequence
  Synthetic Polypeptide encoding a CAR and optional  accessory module(s)
MALPVTALLLPLALLLHAARPSFMLTQSLSVSESPGKTVTISCTRSSGTIATNYVQWYQQRPGSAPTTIIFENDRRPSGVPDRFSGSIDTSSNSASLTISGLRTEDEADYYCQSYDTTDVIFGGGTKLTVLLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLVQSGAEVKKPGESLKISCQGFGYTFTDNWIAWVRQMPGKGLEWVGFTYPDDSDTRYSPSFQGHVTISADKSMRTAFLQWSSLRASDTAMYYCARLGGQCSDGVCYFDHWGRGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11844 - protein, 512 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11845 - protein, 512 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11846 - protein, 688 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11847 - protein, 919 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11848 - protein, 907 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11849 - protein, 872 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11850 - protein, 882 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11851 - protein, 865 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11852 - protein, 857 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11853 - protein, 872 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11854 - protein, 882 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11855 - protein, 865 aa, Artificial Sequence
  Synthetic Polypeptide encoding a CAR and optional  accessory module(s)
MALPVTALLLPLALLLHAARPQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSGGGGSGGGGSGGGGSENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11856 - protein, 631 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11857 - protein, 635 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11858 - protein, 646 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11859 - protein, 645 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11860 - protein, 641 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11861 - protein, 662 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11862 - protein, 1084 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11863 - protein, 1085 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11864 - protein, 1138 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11865 - protein, 1088 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11866 - protein, 1084 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11867 - protein, 902 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11868 - protein, 1246 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11869 - protein, 1085 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11870 - protein, 1410 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11871 - protein, 1077 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11872 - protein, 680 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11873 - protein, 661 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11874 - protein, 631 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11875 - protein, 713 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11876 - protein, 729 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKGGGGSGGGGSGGGGSQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11877 - protein, 668 aa, Artificial Sequence
  Synthetic Polypeptide encoding a CAR and optional  accessory module(s)
MALPVTALLLPLALLLHAARPENVLTQSPGTLSLSPGDRATLSCRASQSFSSSYLAWYQQKPGQAPRLLIYGVSTRATGIPDRFSGSGSGTDFTLTISRLEPEDFAVYFCQQYAYSPATFGQGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTVSLTCSVSGGSISSGGYHWSWIRQHPGKGLEWIGYIYYNGNTYYNPSLESRVTISVDTSKNQFSLKLTSVTAADTAVYYCARNSARAGSHLLLGRDKSWFDPWGQGTLVIVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11878 - protein, 513 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11879 - protein, 513 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11880 - protein, 689 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11881 - protein, 920 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11882 - protein, 908 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11883 - protein, 873 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11884 - protein, 883 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11885 - protein, 866 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11886 - protein, 858 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11887 - protein, 873 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11888 - protein, 883 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11889 - protein, 866 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11890 - protein, 632 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11891 - protein, 636 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11892 - protein, 647 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11893 - protein, 646 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11894 - protein, 642 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11895 - protein, 663 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11896 - protein, 1085 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11897 - protein, 1086 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11898 - protein, 1139 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11899 - protein, 1089 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11900 - protein, 1085 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11901 - protein, 903 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11902 - protein, 1247 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11903 - protein, 1086 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11904 - protein, 1411 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11905 - protein, 1078 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11906 - protein, 681 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11907 - protein, 662 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11908 - protein, 632 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11909 - protein, 714 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11910 - protein, 730 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKGGGGSGGGGSGGGGSQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11911 - protein, 669 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFGVYYCQQYGRSLITFGQGTRLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKLSCKASGGTFYSYSLNWVRQAPGQGLEWMGGIIPFFGSANYAQKFQGRVTITADESTTTAYLELSTLRPDDTAVYYCAGRGETNDYGDGGEFGYYYSYLDDWGKGTTVTVCLTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11912 - protein, 513 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11913 - protein, 513 aa, Artificial Sequence
  Synthetic Polypeptide encoding a CAR and optional  accessory module(s)
MALPVTALLLPLALLLHAARPQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSGGGGSGGGGSGGGGSEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11914 - protein, 689 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11915 - protein, 920 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11916 - protein, 908 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11917 - protein, 873 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11918 - protein, 883 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11919 - protein, 866 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11920 - protein, 858 aa, Artificial Sequence
  Synthetic Polypeptide encoding a CAR and optional  accessory module(s)
MALPVTALLLPLALLLHAARPQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSGGGGSGGGGSGGGGSEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11921 - protein, 873 aa, Artificial Sequence
  Synthetic Polypeptide encoding a CAR and optional  accessory module(s)
MALPVTALLLPLALLLHAARPQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSGGGGSGGGGSGGGGSEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11922 - protein, 883 aa, Artificial Sequence
  Synthetic Polypeptide encoding a CAR and optional  accessory module(s)
MALPVTALLLPLALLLHAARPQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSGGGGSGGGGSGGGGSEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11923 - protein, 866 aa, Artificial Sequence
  Synthetic Polypeptide encoding a CAR and optional  accessory module(s)
MALPVTALLLPLALLLHAARPQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSGGGGSGGGGSGGGGSEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11924 - protein, 632 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11925 - protein, 636 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11926 - protein, 647 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11927 - protein, 646 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11928 - protein, 642 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11929 - protein, 663 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11930 - protein, 1085 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11931 - protein, 1086 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11932 - protein, 1139 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11933 - protein, 1089 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11934 - protein, 1085 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11935 - protein, 903 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11936 - protein, 1247 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11937 - protein, 1086 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11938 - protein, 1411 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11939 - protein, 1078 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11940 - protein, 681 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11941 - protein, 662 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11942 - protein, 632 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11943 - protein, 714 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11944 - protein, 730 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKGGGGSGGGGSGGGGSQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11945 - protein, 669 aa, Artificial Sequence
  Synthetic Polypeptide encoding a CAR and optional  accessory module(s)
MALPVTALLLPLALLLHAARPEIVLTQFPGTLSLSPGERATLSCRASQSVSSNYLAWYQQKPGQAPRLLIYGASSRATAIPDRFSGSGSGTDFTLTISRLEPEDVAVYYCQQYGRSLITFGQGTRLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFESYSINWVRQAPGQGLEWMGGIIPFFGAANYAPRFQGRVTITADESTTTAYLEVNNLRPDDTAVYYCAGRGETNDYGDDGRFGYYYSYMADWGKGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11946 - protein, 513 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11947 - protein, 513 aa, Artificial Sequence
  Synthetic Polypeptide encoding a CAR and optional  accessory module(s)
MALPVTALLLPLALLLHAARPQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSGGGGSGGGGSGGGGSEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11948 - protein, 689 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11949 - protein, 920 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11950 - protein, 908 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11951 - protein, 873 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11952 - protein, 883 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11953 - protein, 866 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11954 - protein, 858 aa, Artificial Sequence
  Synthetic Polypeptide encoding a CAR and optional  accessory module(s)
MALPVTALLLPLALLLHAARPQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSGGGGSGGGGSGGGGSEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11955 - protein, 873 aa, Artificial Sequence
  Synthetic Polypeptide encoding a CAR and optional  accessory module(s)
MALPVTALLLPLALLLHAARPQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSGGGGSGGGGSGGGGSEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11956 - protein, 883 aa, Artificial Sequence
  Synthetic Polypeptide encoding a CAR and optional  accessory module(s)
MALPVTALLLPLALLLHAARPQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSGGGGSGGGGSGGGGSEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11957 - protein, 866 aa, Artificial Sequence
  Synthetic Polypeptide encoding a CAR and optional  accessory module(s)
MALPVTALLLPLALLLHAARPQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSGGGGSGGGGSGGGGSEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11958 - protein, 632 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11959 - protein, 636 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11960 - protein, 647 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11961 - protein, 646 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11962 - protein, 642 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11963 - protein, 663 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11964 - protein, 1085 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11965 - protein, 1086 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11966 - protein, 1139 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 11967 - protein, 1089 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11968 - protein, 1085 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11969 - protein, 903 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11970 - protein, 1247 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 11971 - protein, 1086 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11972 - protein, 1411 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 11973 - protein, 1078 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11974 - protein, 681 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 11975 - protein, 662 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11976 - protein, 632 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 11977 - protein, 714 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11978 - protein, 730 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKGGGGSGGGGSGGGGSQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 11979 - protein, 669 aa, Artificial Sequence
  Synthetic Polypeptide encoding a CAR and optional  accessory module(s)
MALPVTALLLPLALLLHAARPEIVLTQFPGTLSLSPGERATLSCRASQSVSSSQLAWYQQKPGQAPRLLIYGASSRATAIPDRFSGSGSGTDFTLTISRLEPEDFAVYYCQQYGRLLITFGQGTRLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVHLVQSGAEVKKPGSSVKVSCRASGGTFDSYSFNWVRQAPGQGLEWMGGIIPFFGAANYAQNFQGRVTITADESTTTAYLELSSLRPDDTAVYYCAGRGDTNDYGDDGQFGYYYSYMGDWGKGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 11980 - protein, 514 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11981 - protein, 514 aa, Artificial Sequence
  Synthetic Polypeptide encoding a CAR and optional  accessory module(s)
MALPVTALLLPLALLLHAARPQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSGGGGSGGGGSGGGGSEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11982 - protein, 690 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 11983 - protein, 921 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11984 - protein, 909 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11985 - protein, 874 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11986 - protein, 884 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11987 - protein, 867 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11988 - protein, 859 aa, Artificial Sequence
  Synthetic Polypeptide encoding a CAR and optional  accessory module(s)
MALPVTALLLPLALLLHAARPQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSGGGGSGGGGSGGGGSEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 11989 - protein, 874 aa, Artificial Sequence
  Synthetic Polypeptide encoding a CAR and optional  accessory module(s)
MALPVTALLLPLALLLHAARPQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSGGGGSGGGGSGGGGSEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11990 - protein, 884 aa, Artificial Sequence
  Synthetic Polypeptide encoding a CAR and optional  accessory module(s)
MALPVTALLLPLALLLHAARPQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSGGGGSGGGGSGGGGSEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11991 - protein, 867 aa, Artificial Sequence
  Synthetic Polypeptide encoding a CAR and optional  accessory module(s)
MALPVTALLLPLALLLHAARPQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSGGGGSGGGGSGGGGSEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11992 - protein, 633 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11993 - protein, 637 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 11994 - protein, 648 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11995 - protein, 647 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11996 - protein, 643 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11997 - protein, 664 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 11998 - protein, 1086 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 11999 - protein, 1087 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12000 - protein, 1140 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12001 - protein, 1090 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12002 - protein, 1086 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12003 - protein, 904 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12004 - protein, 1248 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12005 - protein, 1087 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12006 - protein, 1412 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12007 - protein, 1079 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12008 - protein, 682 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12009 - protein, 663 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12010 - protein, 633 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12011 - protein, 715 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12012 - protein, 731 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKGGGGSGGGGSGGGGSQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12013 - protein, 670 aa, Artificial Sequence
  Synthetic Polypeptide encoding a CAR and optional  accessory module(s)
MALPVTALLLPLALLLHAARPEIVLTQSPGTLSLSPGETATLSCRASQSVVSNYLAWYQQKPGQAPRLLIYGASRRATAIPDRFSGSGSGTEFTLTISRLEPEDFAVYYCQQYGSSPQVSFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVHLVQSGAEVKKPRSSVRVSCEASGGIFSDFSLNWVRQAPGQGLEWMGGIIPFFGTAFYAPKFQGRLTITADESTSTAYMDLSSLRSDDTAMYFCAGSESPNEYGDSTQFGFYYNYMAVWGKGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12014 - protein, 513 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12015 - protein, 513 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12016 - protein, 689 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12017 - protein, 920 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12018 - protein, 908 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12019 - protein, 873 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12020 - protein, 883 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12021 - protein, 866 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12022 - protein, 858 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12023 - protein, 873 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12024 - protein, 883 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12025 - protein, 866 aa, Artificial Sequence
  Synthetic Polypeptide encoding a CAR and optional  accessory module(s)
MALPVTALLLPLALLLHAARPQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSGGGGSGGGGSGGGGSEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12026 - protein, 632 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12027 - protein, 636 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12028 - protein, 647 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12029 - protein, 646 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12030 - protein, 642 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12031 - protein, 663 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12032 - protein, 1085 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12033 - protein, 1086 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12034 - protein, 1139 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12035 - protein, 1089 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12036 - protein, 1085 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12037 - protein, 903 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12038 - protein, 1247 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12039 - protein, 1086 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12040 - protein, 1411 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12041 - protein, 1078 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12042 - protein, 681 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12043 - protein, 662 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12044 - protein, 632 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12045 - protein, 714 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12046 - protein, 730 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKGGGGSGGGGSGGGGSQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12047 - protein, 669 aa, Artificial Sequence
  Synthetic Polypeptide encoding a CAR and optional  accessory module(s)
MALPVTALLLPLALLLHAARPEIVLTQFPGTLSLSPGEGATLSCRASQSISSSQLAWYQQRPGQAPRLLIYGASSRATAIPDRFSGSGSGTDFTLTISRLEPEDFAVYYCQQYGRSLITFGQGTRLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKLSCKASGGTFYSYSINWVRQAPGQGLEWMGGIIPFFGSANYAQKFQGRVTITADESTTTAYLELSSLRPDDTAVYYCAGRGETNDYADGGEFGYYYSYMADWGKGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12048 - protein, 502 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12049 - protein, 502 aa, Artificial Sequence
  Synthetic Polypeptide encoding a CAR and optional  accessory module(s)
MALPVTALLLPLALLLHAARPQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12050 - protein, 678 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12051 - protein, 909 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12052 - protein, 897 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12053 - protein, 862 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12054 - protein, 872 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12055 - protein, 855 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12056 - protein, 847 aa, Artificial Sequence
  Synthetic Polypeptide encoding a CAR and optional  accessory module(s)
MALPVTALLLPLALLLHAARPQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12057 - protein, 862 aa, Artificial Sequence
  Synthetic Polypeptide encoding a CAR and optional  accessory module(s)
MALPVTALLLPLALLLHAARPQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12058 - protein, 872 aa, Artificial Sequence
  Synthetic Polypeptide encoding a CAR and optional  accessory module(s)
MALPVTALLLPLALLLHAARPQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12059 - protein, 855 aa, Artificial Sequence
  Synthetic Polypeptide encoding a CAR and optional  accessory module(s)
MALPVTALLLPLALLLHAARPQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12060 - protein, 621 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12061 - protein, 625 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12062 - protein, 636 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12063 - protein, 635 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12064 - protein, 631 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12065 - protein, 652 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12066 - protein, 1074 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12067 - protein, 1075 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12068 - protein, 1128 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12069 - protein, 1078 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12070 - protein, 1074 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12071 - protein, 892 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12072 - protein, 1236 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12073 - protein, 1075 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12074 - protein, 1400 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12075 - protein, 1067 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12076 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12077 - protein, 651 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12078 - protein, 621 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12079 - protein, 703 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12080 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12081 - protein, 658 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12082 - protein, 503 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12083 - protein, 503 aa, Artificial Sequence
  Synthetic Polypeptide encoding a CAR and optional  accessory module(s)
MALPVTALLLPLALLLHAARPQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGGSGGGGSGGGGSDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12084 - protein, 679 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12085 - protein, 910 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12086 - protein, 898 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12087 - protein, 863 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12088 - protein, 873 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12089 - protein, 856 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12090 - protein, 848 aa, Artificial Sequence
  Synthetic Polypeptide encoding a CAR and optional  accessory module(s)
MALPVTALLLPLALLLHAARPQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGGSGGGGSGGGGSDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12091 - protein, 863 aa, Artificial Sequence
  Synthetic Polypeptide encoding a CAR and optional  accessory module(s)
MALPVTALLLPLALLLHAARPQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGGSGGGGSGGGGSDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12092 - protein, 873 aa, Artificial Sequence
  Synthetic Polypeptide encoding a CAR and optional  accessory module(s)
MALPVTALLLPLALLLHAARPQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGGSGGGGSGGGGSDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12093 - protein, 856 aa, Artificial Sequence
  Synthetic Polypeptide encoding a CAR and optional  accessory module(s)
MALPVTALLLPLALLLHAARPQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGGSGGGGSGGGGSDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12094 - protein, 622 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12095 - protein, 626 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12096 - protein, 637 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12097 - protein, 636 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12098 - protein, 632 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12099 - protein, 653 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12100 - protein, 1075 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12101 - protein, 1076 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12102 - protein, 1129 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12103 - protein, 1079 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12104 - protein, 1075 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12105 - protein, 893 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12106 - protein, 1237 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12107 - protein, 1076 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12108 - protein, 1401 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12109 - protein, 1068 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12110 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12111 - protein, 652 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12112 - protein, 622 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12113 - protein, 704 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12114 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12115 - protein, 659 aa, Artificial Sequence
  Synthetic Polypeptide encoding a CAR and optional  accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12116 - protein, 504 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12117 - protein, 504 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12118 - protein, 680 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12119 - protein, 911 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12120 - protein, 899 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12121 - protein, 864 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12122 - protein, 874 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12123 - protein, 857 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12124 - protein, 849 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12125 - protein, 864 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12126 - protein, 874 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12127 - protein, 857 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12128 - protein, 623 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12129 - protein, 627 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12130 - protein, 638 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12131 - protein, 637 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12132 - protein, 633 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12133 - protein, 654 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12134 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12135 - protein, 1077 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12136 - protein, 1130 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12137 - protein, 1080 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12138 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12139 - protein, 894 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12140 - protein, 1238 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12141 - protein, 1077 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12142 - protein, 1402 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12143 - protein, 1069 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12144 - protein, 672 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12145 - protein, 653 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12146 - protein, 623 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12147 - protein, 705 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12148 - protein, 721 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12149 - protein, 660 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSRTDFTLTISSVEPEDFAVYYCLQSRTIPRTFGQGTKLEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12150 - protein, 498 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGSGEAHHDASAATTNTGAHHRVAAPVPAPRGVPASGGGRSAHEGAGLRLHLHLGALGRDLWGPSPVTGYHPLLQTGQKETPVYIQTTIYETSTNYSRGRWLLPISRRRRRRMTESEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSL

SEQ ID NO: 12151 - protein, 499 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQENAAETDLGRGSGEAHHDASAATTNTGAHHRVAAPVPAPRGVPASGGGRSAHEGAGLRLHLHLGALGRDLWGPSPVTGYHPLLQTGQKETPVYIQTTIYETSTNYSRGRWLLPISRRRRRRMTESEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSL

SEQ ID NO: 12152 - protein, 668 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGSGEAHHDASAATTNTGAHHRVAAPVPAPRGVPASGGGRSAHEGAGLRLHLHLGALGRDLWGPSPVTGYHPLLRARQSEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSLRIWSNKLLTTQTSRRGGESRAWDPHGHLRGSLGGAETGHGQGSGIVPPKRVHTSTHTGPINWSSSFKGGGQVNVSPVSGMSVSCRSQRPLARPASLRPAFFRAPPSGHNELFQPLSAHCSPRRRGAVCEGYVFDIFKQGHYRVSQHTTDILTLGVLYGKLRPTGSHRGCPNVNAIFVKSRPTAPSANPNGPSPFRPITLPTLSPYTM

SEQ ID NO: 12153 - protein, 893 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGSGEAHHDASAATTNTGAHHRVAAPVPAPRGVPASGGGRSAHEGAGLRLHLHLGALGRDLWGPSPVTGYHPLLRARQSEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12154 - protein, 877 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYARRGDGRNHSNPLQSLNFRNNCYPYMSPVSWQRDPLAARQEYRGRRREYRIRGSLEPERVLRATKRILCVLSARVKAGRRLLPLSPSQSVRKLHGNGRYVRCYNSYRRYMHHGWTASAGLLLVQEKGQSTRDQRRWRRRKAKGTKQRTATTSAKSRLAYSERTEGPVLWPESEKNLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12155 - protein, 851 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAFQDPHRGTGRSGVRELQHLYHLGGRHRGNTAERHHQTGPRQADSGPSGHLQMQRHRHLQGQRKHRAGPLQNVPVLRGTGPCYSGRHHRDRCDRYSAAGSGSVLLRRTRNRQTVWRCRYTGPAEKRPSVSAPARQRCPVFSPRRQLGKQVRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12156 - protein, 858 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYASEHQGQPPGQGVRLPRGRQRAADMCRGQEHHLVGRQDDRLPDRGQEEVEPGQQRGPQRHVSVQGQPEQEQAPPGVLPDVPELHRAERRYHQRLSVRRDRVHLRAGRGRVLYRWTGWRAAEQSFRANPAARPAVPASEGQRGRPVQPPPGQSAEKKLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12157 - protein, 835 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYASEFWVVGPIVLSVGRNPVHLRSDPDRIVPAGVFQIRRRTRLPTRAEPTLQTFGAEGRVRRSGQKEGTRSRDGRKASAKEESARGALRTPERNGRSLDWDEGRKEEGRSRWVVPRIEHSHRYLCAPHAGPAAKIRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12158 - protein, 830 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQENARRGDGRNHSNPLQSLNFRNNCYPYMSPVSWQRDPLAARQEYRGRRREYRIRGSLEPERVLRATKRILCVLSARVKAGRRLLPLSPSQSVRKLHGNGRYVRCYNSYRRYMHHGWTASAGLLLVQEKGQSTRDQRRWRRRKAKGTKQRTATTSAKSRLAYSERTEGPVLWPESEKNLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLA

SEQ ID NO: 12159 - protein, 852 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQENAFQDPHRGTGRSGVRELQHLYHLGGRHRGNTAERHHQTGPRQADSGPSGHLQMQRHRHLQGQRKHRAGPLQNVPVLRGTGPCYSGRHHRDRCDRYSAAGSGSVLLRRTRNRQTVWRCRYTGPAEKRPSVSAPARQRCPVFSPRRQLGKQVRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12160 - protein, 859 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQENASEHQGQPPGQGVRLPRGRQRAADMCRGQEHHLVGRQDDRLPDRGQEEVEPGQQRGPQRHVSVQGQPEQEQAPPGVLPDVPELHRAERRYHQRLSVRRDRVHLRAGRGRVLYRWTGWRAAEQSFRANPAARPAVPASEGQRGRPVQPPPGQSAEKKLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12161 - protein, 836 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQENASEFWVVGPIVLSVGRNPVHLRSDPDRIVPAGVFQIRRRTRLPTRAEPTLQTFGAEGRVRRSGQKEGTRSRDGRKASAKEESARGALRTPERNGRSLDWDEGRKEEGRSRWVVPRIEHSHRYLCAPHAGPAAKIRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12162 - protein, 618 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAYPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQ

SEQ ID NO: 12163 - protein, 623 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRDPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQPRQEKRIWREADPEFRPAEAGWRRGIQPRPYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGM

SEQ ID NO: 12164 - protein, 632 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRAWWRRISGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYASWRRRVSYPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQ

SEQ ID NO: 12165 - protein, 632 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGCGARKGGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYASCGCAQGDPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQ

SEQ ID NO: 12166 - protein, 627 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGRSKGGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYASSRQDPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQ

SEQ ID NO: 12167 - protein, 648 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGETNSQPSSGTGFNRQRRGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGSGERHPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQ

SEQ ID NO: 12168 - protein, 1059 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAYPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQPRQEKRIWREADPEFRPAEAGWRRGIQPRPFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12169 - protein, 1059 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRDPEPSCRVPAAGQEQRQERVSVHRLRQPDQRVPEQGLRRVHHRVRAGHAEHGLQEQLRRGLVQQVRFRLRQRLQQQHYPRGHILPKQRRALRREAGGKELRDRHQPELPEPERDRLQNPAAESGRLPADDPAAVVQPRQEKRIWREADPEFRPAEAGWRRGIQPRPYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAGPEERVPTGGRVRAQGRDRPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRHHQRQLPPGRAERHHPVRDPAGQGHPVRRAGVCPGADGYGQAEGQPGKGQAIWIWSNKLLTTQTSRRGGESRAFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12170 - protein, 1108 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQPHQDRCDYNGPQGQLLQGRQRYPAAPADQHQRLLHVLVAAAEVRGVLRHHHMLPAAENRLLLQRREVGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYACLYKGTLRVSSGSQQQVYKRRNSRSGLPGQGLLSRACDRVLERSTDKRRAHLSSRAAKQRPVLSEQRGHSALPGHPDLHLQCEPQAQHQGGQESGTQELSENRLHRPREAQRDREHQAAQQELPQAQGHRAHRESEHDEPDRAGPADAVRQNRGRELPADRQAVLPPRQEKRIWREADPEFRPAEAGWRRGIQPRPFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHATLLLSQVPVSGPYGHPADTCHGVHV

SEQ ID NO: 12171 - protein, 1062 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRHHQRQLPPGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYACLYKGTLRVSSGSQQQVYKRRNSRSGLPGQGLLSRACDRVLERSTDKRRAHLSSRAAKQRPVLSEQRGHSALPGHPDLHLQCEPQAQHQGGQESGTQELYPRGHILPKQRRALRREAGGKELRDRHQPELPEPERDRLQNPAAESGRLPADDPAAVVQPRQEKRIWREADPEFRPAEAGWRRGIQPRPFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12172 - protein, 1061 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAWTAGQSYRDTVPSKQRRTPGQQGHTCVPDLRLLPWGCDSGLEGRWISCESRRGNHQAIQAEQQQIRRQLLPEPDTAVEVPQILQLPSDPRRQHRGKDSGPYRVQRQSRLRLYQRELPAGRAERHHPVRDPAGQGHPVRRAGVCPGADGYGQAEGQPGTRQEKRIWREADPEFRPAEAGWRRGIQPRPFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12173 - protein, 877 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYACEAHHDASAATTNTGAHHRVAAPVPAPRGVPASGGGRSAHEGAGLRLHLHLGALGRDLWGPSPVTGYHPLLRARQSEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSLRIWSNKLLTTQTSRRGGESRAWDPHEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQPRNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVH

SEQ ID NO: 12174 - protein, 1196 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYACEAHHDASAATTNTGAHHRVAAPVPAPRGVPASGGGRSAHEGAGLRLHLHLGALGRDLWGPSPVTGYHPLLRARQSEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSLRIWSNKLLTTQTSRRGGESRAWDPHELVTFPDNADMWGLGNERAPWDRGIWKCHPMAQSGNRADCHQAVPAGAQPPEPRAVVPGDPDHEKADPPQCGGCPRCPGDAELGAQPAPAGHGVLPRRRSPEVPEPVELLWSAGRCHPHLAEHCLCAIPSKQNHPSGSKARKHRPAARRTEVNTQNYPRICQGAGSGRALHRIRGDPAVPGPRATGAAEVHSDRRLLELRHPGLVHHGLPALPPQLAARAVAFKSAAEEGGHCCRRLEWNGEVFKLFTLPQSQCPGATGEVAATDADVAPPTEGHGSHVWAQWLLQGPGHLKLKAGSYLEHGHGHHPHLPCDRGESAELEGQNPTGHGHPRGGPGAAAGSGPGVDPRACHSVYFRRQVKGPHIGHGSCFSLQQNHLDSDLPTAPTKCQLYPSRAQEESRLLPAEEGVGPGLAQHPDPEGRLQPAAAGTASRHDESPPKQQLPLQNEEFHGFHVSAAQGQVGFLQNQHPDPGEVQRANRVWDHIRTAAGLEGNGAGCGALWAGERSETPGRTDDGSADRHCGLTEEPHGPEAGGNAGRPRGASKGAVQETKGKTSRPANGQSGNGTAAASGNSELREESASDLYAAQNCGLQAEGAGTVAQGGRGGELNEGEDCCPAAGEAAEGALESPEDCLQGPWSCQWKPGHECLSTPAWAADVSALHGLQQLTASQEERTGGSTPLHPARKCHTGHCEGTRPEFHGPRLELVTDGRRRAQLPGAGL

SEQ ID NO: 12175 - protein, 1059 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRDPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLQNPAAESGRLPADDPAAVVQPRQEKRIWREADPEFRPAEAGWRRGIQPRPYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQRGGQAEARNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVHV

SEQ ID NO: 12176 - protein, 1335 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAYPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLQNPAAESGRLPADDPAAVVQPRQEKRIWREADPEFRPAEAGWRRGIQPRPFRPYGAAPGAAAGRGRALGDAGAAGHRRLRERLSVPASGTSQNSNVLSPRAKYQKQRTMVPNPDYEEVEPCQCCKGLCSRIEYFDSCASSSNGILFWRRSPKAAQQTRKLLWTRKPDTFFTKYRVWDSIFAKQNYTSRSKTKHSSSGCWWKDNTNNSGICQRCSRRAVYRVCGNTAVSGPRALEALHSHCLLELWDHGIMYCWIAFFASSAAIYLAEDEEGSKVYICMRDVRRSSVPFTSTKPLFNSRTHGKLATVDVELGPSAERRTCPYFEAAKMFCINGSHFEFEDSTHPKYDFCKDNFFSVTTKSSFTTVSYANWNKYWFSRTSFRDRNFSGSSETSLSMCSRWSRLLYGLFVKNCIRAICFQKFILCKLYCTGQQNTASNYTAASVGSSALCVWTKRRLQALSGTKGSNVKSSICLNKNEEHFDLSITTTESIGVFSQKHSALGEIQRADDVWDIFRKNAKSMERNGRKGHPLCGWCHWIPGGSDYVFACNHGATEEPLWKTSGRLDGISGTACHSIAVKTQTFRSLLQQHRDGENHCAHCAESGPCAQGAVWSFEQVVGLAEDYSTPGGSGPQYQRSQYCHVHAGKKAERNMASPNCLYTEFCPLSCRIQSRRCSNPSDISMAAPDFSRTSFSVMCGNSSRWGDFSTNDRRKFELPWPFKHYYSGKGTGQYDESLELVNRM

SEQ ID NO: 12177 - protein, 1052 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAYPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLQNPAAESGRLPADDPAAVVQPRQEKRIWREADPEFRPAEAGWRRGIQPRPFRPYEAPLEEPTVDGAAQWWPGSRSGRTGRRVSSGEASHAAPAFRTGRSDPPALPGGESRAPRCHPAEQPDSAGALRGASAFPSQPEGGEGVPHVQVPGGQETGGETRPGEARSEEAEGAGSAGGGAPEEMPAADGGQGLCESPGDVLARGAAGEPESLGGCHGMPGSGGSGPGGQRAGAAAGEARGAAAAAQRAGGPAAHAGPERGGRAPHGAPGRLGGEEEAGPVAGGLSPALPRIRQPHQEQPRNAAGRSQTAAPAGRGGPGGRTGGDRAEGGGRAAQDCDGDRSGAEGPGGYLQGGLPGEAGPGEAGREEGAPAGAAGAAAEGVQQTEGQLSGVGQDRGHEEAACRGLPGPLAPRPCLPLLSPGPAQPEEEPPRGATLLLSQVPVSGPYGHPADTCHGVH

SEQ ID NO: 12178 - protein, 673 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAWETNSQPSSGTGFNRQRRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGM

SEQ ID NO: 12179 - protein, 647 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGETNSQPSSGTGFNRQRRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGWERHPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLQNPAAESGRLPADDPAAVVQ

SEQ ID NO: 12180 - protein, 618 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAYPEPSCRVPAAGQEQRQERVSVHRLRQPDQRVPEQGLRRVHHRDRAGHAEHGLQEQLRRGLVQQVRFRLRQRLQQQHYPRGHILPKPREQLRREAGGKELRDRHQPELPEPERDRLQNPAAESGRLPADDPAAVVQ

SEQ ID NO: 12181 - protein, 699 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGWERHPIPFSGPSHHAAGGRQAADGGRVPGAGCGPTWTGQPHLVRRQWLCPGRLYLRPKPCHRWHLDKSGPPEPAQRGTGFLGASRVPHRTWRGTQQIHPAYAPVWRGQHRQNLSSGTSERHPWRSTVAGSAETAAVQAAAVPAADLLLSVRSCRPSAFSCHHHKTESPGQPQTAPCHRDRRQRGHKQPTPAQRQKMGRYPPWQKAWISS

SEQ ID NO: 12182 - protein, 718 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQERRRRKWRRRIWRRRLTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGSGERHPIPFSGPSHHAAGGRQAADGGRVPGAGCGPTWTGQPHLVRRQWLCPGRLYLRPKPCHRWHLDKSGPPEPAQRGTGFLGASRVPHRTWRGTQQIHPAYAPVWRGQHRQNLSSGTSERHPWRSTVAGSAETAAVQAAAVPAADLLLSVRSCRPSAFSCHHHKTESPGQPQTAPCHRDRRQRGHKQPTPAQRQKMGRYPPWQKAWISS

SEQ ID NO: 12183 - protein, 657 aa, Artificial Sequence
  Synthetic Polypeptide encoding a CAR and optional  accessory module(s)
MALPVTALLLPLALLLHAARPDIQMTQSPSSLSASVGDRVTITCKASDHINNWLAWYQQKPGKAPKLLIYGATTLETGVPSRFSGSGYGTDFTLTISSLHPDHQQRGTRGLRRVLLPPEPDHPQNIRPGHQAGNQETRGETNSQPSSGTGFNRQRRQAAGRRRVPQAYHLPALYRRDKAPEGRHLPVPAGKVLPRCDDPLAGKEVQHHPGQPGRQHHEDQRHLHEVQLADRAREVPGQRTQMHRAARKQQERRGPGNHLPTHQDRCDYNGPQGQLLQGRQRYPAAPADQHQRLLHVLVAAAEVRGVLRHHHMLPAAENRLLLQRREVGQAIWIWSNKLLTTQTSRRGGESRAYYGLDLAHPFPCRRCYRRAFLRRTSSAGAVWLRAEETWRVREDQLQGQRLHLHRLQHQLGQAGPRPGPEVDGQNQHRERRAHLRRRLQGPVQLHRGHQRQHSLSPDQLSEGRGYRRVLLRPGLQLRYGLLGPGHPGHSLFYAAETDLGRGWERQPASHQAQRVRDEERHQRGLPRERVLPQGHQDQPGVQQEDHRVRPRHRDLPQRQVQRREAGEVRGQQQRDLLRAARQQDRAQHRLSENRLHRPREAQRDREHQAAQQELPQAQGHRAHRESEHDEPDRAGPADAVRQNRGRELPADRQAVLP

SEQ ID NO: 12184 - protein, 504 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12185 - protein, 504 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12186 - protein, 680 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12187 - protein, 911 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12188 - protein, 899 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12189 - protein, 864 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12190 - protein, 874 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12191 - protein, 857 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12192 - protein, 849 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12193 - protein, 864 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12194 - protein, 874 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12195 - protein, 857 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12196 - protein, 623 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12197 - protein, 627 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12198 - protein, 638 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12199 - protein, 637 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12200 - protein, 633 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12201 - protein, 654 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12202 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12203 - protein, 1077 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12204 - protein, 1130 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12205 - protein, 1080 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12206 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12207 - protein, 894 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12208 - protein, 1238 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12209 - protein, 1077 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12210 - protein, 1402 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12211 - protein, 1069 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12212 - protein, 672 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12213 - protein, 653 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12214 - protein, 623 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12215 - protein, 705 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12216 - protein, 721 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12217 - protein, 660 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRTIPRTFGQGTKLEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12218 - protein, 503 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12219 - protein, 503 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12220 - protein, 679 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12221 - protein, 910 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12222 - protein, 898 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12223 - protein, 863 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12224 - protein, 873 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12225 - protein, 856 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12226 - protein, 848 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12227 - protein, 863 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12228 - protein, 873 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12229 - protein, 856 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12230 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12231 - protein, 626 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12232 - protein, 637 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12233 - protein, 636 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12234 - protein, 632 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12235 - protein, 653 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12236 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12237 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12238 - protein, 1129 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12239 - protein, 1079 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12240 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12241 - protein, 893 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12242 - protein, 1237 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12243 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12244 - protein, 1401 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12245 - protein, 1068 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12246 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12247 - protein, 652 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12248 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12249 - protein, 704 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12250 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12251 - protein, 659 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPKLLIYLASNLETGVPARFSGSGSGTDFTLTISSLQAEDAAIYYCLQSRIFPRTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12252 - protein, 503 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12253 - protein, 503 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12254 - protein, 679 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12255 - protein, 910 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12256 - protein, 898 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12257 - protein, 863 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12258 - protein, 873 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12259 - protein, 856 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12260 - protein, 848 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12261 - protein, 863 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12262 - protein, 873 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12263 - protein, 856 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12264 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12265 - protein, 626 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12266 - protein, 637 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12267 - protein, 636 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12268 - protein, 632 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12269 - protein, 653 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12270 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12271 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12272 - protein, 1129 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12273 - protein, 1079 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12274 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12275 - protein, 893 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12276 - protein, 1237 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12277 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12278 - protein, 1401 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12279 - protein, 1068 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12280 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12281 - protein, 652 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12282 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12283 - protein, 704 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12284 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12285 - protein, 659 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSGTDFTLTISSLQAEDAAIYYCLQSRIFPRTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12286 - protein, 503 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12287 - protein, 503 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12288 - protein, 679 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12289 - protein, 910 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12290 - protein, 898 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12291 - protein, 863 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12292 - protein, 873 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12293 - protein, 856 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12294 - protein, 848 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12295 - protein, 863 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12296 - protein, 873 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12297 - protein, 856 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12298 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12299 - protein, 626 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12300 - protein, 637 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12301 - protein, 636 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12302 - protein, 632 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12303 - protein, 653 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12304 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12305 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12306 - protein, 1129 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12307 - protein, 1079 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12308 - protein, 1075 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12309 - protein, 893 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12310 - protein, 1237 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12311 - protein, 1076 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12312 - protein, 1401 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12313 - protein, 1068 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12314 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12315 - protein, 652 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12316 - protein, 622 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12317 - protein, 704 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12318 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12319 - protein, 659 aa, Artificial Sequence
  Synthetic Polypeptide encoding a CAR and optional  accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRIFPRTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12320 - protein, 503 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12321 - protein, 503 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12322 - protein, 679 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12323 - protein, 910 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12324 - protein, 898 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12325 - protein, 863 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12326 - protein, 873 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12327 - protein, 856 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12328 - protein, 848 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12329 - protein, 863 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12330 - protein, 873 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12331 - protein, 856 aa, Artificial Sequence
  Synthetic Polypeptide encoding a CAR and optional  accessory module(s)
MALPVTALLLPLALLLHAARPEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSGGGGSGGGGSGGGGSDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12332 - protein, 622 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12333 - protein, 626 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12334 - protein, 637 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12335 - protein, 636 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12336 - protein, 632 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12337 - protein, 653 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12338 - protein, 1075 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12339 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12340 - protein, 1129 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12341 - protein, 1079 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12342 - protein, 1075 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12343 - protein, 893 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12344 - protein, 1237 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12345 - protein, 1076 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12346 - protein, 1401 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12347 - protein, 1068 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12348 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12349 - protein, 652 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12350 - protein, 622 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12351 - protein, 704 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12352 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKGGGGSGGGGSGGGGSEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12353 - protein, 659 aa, Artificial Sequence
  Synthetic Polypeptide encoding a CAR and optional  accessory module(s)
MALPVTALLLPLALLLHAARPDIVLTQSPASLAVSLGERATINCRASESVSVIGAHLIHWYQQKPGQPPRLLIQLASNVQTGVPARFSGSGSGTDFTLTISSLQAEDAAIYYCLQSRIFPRTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQVQLVQSGSELKKPGESVKISCKASGYTFTDYSINWVKQAPGQGLKWMGRINTESGVPIYADDFKGRFSFTVDTSASTAYLQISSLKAEDTAVYFCALDYSYAMDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12354 - protein, 505 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12355 - protein, 505 aa, Artificial Sequence
  Synthetic Polypeptide encoding a CAR and optional  accessory module(s)
MALPVTALLLPLALLLHAARPQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGGSGGGGSGGGGSQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12356 - protein, 681 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12357 - protein, 912 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12358 - protein, 900 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12359 - protein, 865 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12360 - protein, 875 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12361 - protein, 858 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12362 - protein, 850 aa, Artificial Sequence
  Synthetic Polypeptide encoding a CAR and optional  accessory module(s)
MALPVTALLLPLALLLHAARPQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGGSGGGGSGGGGSQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12363 - protein, 865 aa, Artificial Sequence
  Synthetic Polypeptide encoding a CAR and optional  accessory module(s)
MALPVTALLLPLALLLHAARPQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGGSGGGGSGGGGSQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12364 - protein, 875 aa, Artificial Sequence
  Synthetic Polypeptide encoding a CAR and optional  accessory module(s)
MALPVTALLLPLALLLHAARPQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGGSGGGGSGGGGSQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12365 - protein, 858 aa, Artificial Sequence
  Synthetic Polypeptide encoding a CAR and optional  accessory module(s)
MALPVTALLLPLALLLHAARPQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGGSGGGGSGGGGSQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12366 - protein, 624 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12367 - protein, 628 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12368 - protein, 639 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12369 - protein, 638 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12370 - protein, 634 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12371 - protein, 655 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12372 - protein, 1077 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12373 - protein, 1078 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12374 - protein, 1131 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12375 - protein, 1081 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12376 - protein, 1077 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12377 - protein, 895 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12378 - protein, 1239 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12379 - protein, 1078 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12380 - protein, 1403 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12381 - protein, 1070 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12382 - protein, 673 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12383 - protein, 654 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12384 - protein, 624 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12385 - protein, 706 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12386 - protein, 722 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12387 - protein, 661 aa, Artificial Sequence
  Synthetic Polypeptide encoding a CAR and optional  accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12388-12421 - skipped (34 entries)

SEQ ID NO: 12422 - protein, 497 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12423 - protein, 497 aa, Artificial Sequence
  Synthetic Polypeptide encoding a CAR and optional  accessory module(s)
MALPVTALLLPLALLLHAARPEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12424 - protein, 673 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12425 - protein, 904 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12426 - protein, 892 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12427 - protein, 857 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12428 - protein, 867 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12429 - protein, 850 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12430 - protein, 842 aa, Artificial Sequence
  Synthetic Polypeptide encoding a CAR and optional  accessory module(s)
MALPVTALLLPLALLLHAARPEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12431 - protein, 857 aa, Artificial Sequence
  Synthetic Polypeptide encoding a CAR and optional  accessory module(s)
MALPVTALLLPLALLLHAARPEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12432 - protein, 867 aa, Artificial Sequence
  Synthetic Polypeptide encoding a CAR and optional  accessory module(s)
MALPVTALLLPLALLLHAARPEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12433 - protein, 850 aa, Artificial Sequence
  Synthetic Polypeptide encoding a CAR and optional  accessory module(s)
MALPVTALLLPLALLLHAARPEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12434 - protein, 616 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12435 - protein, 620 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12436 - protein, 631 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12437 - protein, 630 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12438 - protein, 626 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12439 - protein, 647 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12440 - protein, 1069 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12441 - protein, 1070 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12442 - protein, 1123 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12443 - protein, 1073 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12444 - protein, 1069 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12445 - protein, 887 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12446 - protein, 1231 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12447 - protein, 1070 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12448 - protein, 1395 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12449 - protein, 1062 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12450 - protein, 665 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12451 - protein, 646 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12452 - protein, 616 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12453 - protein, 698 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12454 - protein, 714 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12455 - protein, 653 aa, Artificial Sequence
  Synthetic Polypeptide encoding a CAR and optional  accessory module(s)
MALPVTALLLPLALLLHAARPEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12456 - protein, 503 aa, Artificial Sequence; identical to SEQ ID NO: 5503
  Synthetic Polypeptide encoding a CAR and optional  accessory module(s)

SEQ ID NO: 12457 - protein, 503 aa, Artificial Sequence
  Synthetic Polypeptide encoding a CAR and optional  accessory module(s)
MALPVTALLLPLALLLHAARPQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSGGGGSGGGGSGGGGSDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12458 - protein, 679 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12459 - protein, 910 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12460 - protein, 898 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12461 - protein, 863 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12462 - protein, 873 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12463 - protein, 856 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12464 - protein, 848 aa, Artificial Sequence
  Synthetic Polypeptide encoding a CAR and optional  accessory module(s)
MALPVTALLLPLALLLHAARPQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSGGGGSGGGGSGGGGSDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12465 - protein, 863 aa, Artificial Sequence
  Synthetic Polypeptide encoding a CAR and optional  accessory module(s)
MALPVTALLLPLALLLHAARPQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSGGGGSGGGGSGGGGSDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12466 - protein, 873 aa, Artificial Sequence
  Synthetic Polypeptide encoding a CAR and optional  accessory module(s)
MALPVTALLLPLALLLHAARPQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSGGGGSGGGGSGGGGSDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12467 - protein, 856 aa, Artificial Sequence
  Synthetic Polypeptide encoding a CAR and optional  accessory module(s)
MALPVTALLLPLALLLHAARPQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSGGGGSGGGGSGGGGSDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12468 - protein, 622 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12469 - protein, 626 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12470 - protein, 637 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12471 - protein, 636 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12472 - protein, 632 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12473 - protein, 653 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12474 - protein, 1075 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12475 - protein, 1076 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12476 - protein, 1129 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12477 - protein, 1079 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12478 - protein, 1075 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12479 - protein, 893 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12480 - protein, 1237 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12481 - protein, 1076 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12482 - protein, 1401 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12483 - protein, 1068 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12484 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12485 - protein, 652 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12486 - protein, 622 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12487 - protein, 704 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12488 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12489 - protein, 659 aa, Artificial Sequence
  Synthetic Polypeptide encoding a CAR and optional  accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12490 - protein, 502 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12491 - protein, 502 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12492 - protein, 678 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12493 - protein, 909 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12494 - protein, 897 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12495 - protein, 862 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12496 - protein, 872 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12497 - protein, 855 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12498 - protein, 847 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12499 - protein, 862 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12500 - protein, 872 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12501 - protein, 855 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSGGGGSGGGGSGGGGSEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12502 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12503 - protein, 625 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12504 - protein, 636 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12505 - protein, 635 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12506 - protein, 631 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12507 - protein, 652 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12508 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12509 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12510 - protein, 1128 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12511 - protein, 1078 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12512 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12513 - protein, 892 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12514 - protein, 1236 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12515 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12516 - protein, 1400 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12517 - protein, 1067 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12518 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12519 - protein, 651 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12520 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12521 - protein, 703 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12522 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKGGGGSGGGGSGGGGSEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12523 - protein, 658 aa, Artificial Sequence
  Synthetic Polypeptide encoding a CAR and optional  accessory module(s)
MALPVTALLLPLALLLHAARPEIVLTQSPGTLSLSPGERATLSCRASQSVRGNYLAWYQQKPGQAPRLLIYGASSRATGIPDRFSGSGSGTDFTLTISRLEPEDFAVYYCQQYGYSPFTFGCGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSAISGSGGSTFYAESVQGRFTISRDNSKNTLYLQVNSLRAEDTAVYYCARHDYSNYPYFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12524 - protein, 500 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12525 - protein, 500 aa, Artificial Sequence
  Synthetic Polypeptide encoding a CAR and optional  accessory module(s)
MALPVTALLLPLALLLHAARPQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12526 - protein, 676 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12527 - protein, 907 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12528 - protein, 895 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12529 - protein, 860 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12530 - protein, 870 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12531 - protein, 853 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12532 - protein, 845 aa, Artificial Sequence
  Synthetic Polypeptide encoding a CAR and optional  accessory module(s)
MALPVTALLLPLALLLHAARPQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12533 - protein, 860 aa, Artificial Sequence
  Synthetic Polypeptide encoding a CAR and optional  accessory module(s)
MALPVTALLLPLALLLHAARPQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12534 - protein, 870 aa, Artificial Sequence
  Synthetic Polypeptide encoding a CAR and optional  accessory module(s)
MALPVTALLLPLALLLHAARPQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12535 - protein, 853 aa, Artificial Sequence
  Synthetic Polypeptide encoding a CAR and optional  accessory module(s)
MALPVTALLLPLALLLHAARPQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSGGGGSGGGGSGGGGSAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12536 - protein, 619 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12537 - protein, 623 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12538 - protein, 634 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12539 - protein, 633 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12540 - protein, 629 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12541 - protein, 650 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12542 - protein, 1072 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12543 - protein, 1073 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12544 - protein, 1126 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12545 - protein, 1076 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12546 - protein, 1072 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12547 - protein, 890 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12548 - protein, 1234 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12549 - protein, 1073 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12550 - protein, 1398 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12551 - protein, 1065 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12552 - protein, 668 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12553 - protein, 649 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12554 - protein, 619 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12555 - protein, 701 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12556 - protein, 717 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKGGGGSGGGGSGGGGSQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12557 - protein, 656 aa, Artificial Sequence
  Synthetic Polypeptide encoding a CAR and optional  accessory module(s)
MALPVTALLLPLALLLHAARPAIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12558 - protein, 502 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12559 - protein, 502 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12560 - protein, 678 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12561 - protein, 909 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12562 - protein, 897 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12563 - protein, 862 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12564 - protein, 872 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12565 - protein, 855 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12566 - protein, 847 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12567 - protein, 862 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12568 - protein, 872 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12569 - protein, 855 aa, Artificial Sequence
  Synthetic Polypeptide encoding a CAR and optional  accessory module(s)
MALPVTALLLPLALLLHAARPEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSGGGGSGGGGSGGGGSEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12570 - protein, 621 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12571 - protein, 625 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12572 - protein, 636 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12573 - protein, 635 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12574 - protein, 631 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12575 - protein, 652 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12576 - protein, 1074 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12577 - protein, 1075 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12578 - protein, 1128 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12579 - protein, 1078 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12580 - protein, 1074 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12581 - protein, 892 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12582 - protein, 1236 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12583 - protein, 1075 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12584 - protein, 1400 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12585 - protein, 1067 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12586 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12587 - protein, 651 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12588 - protein, 621 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12589 - protein, 703 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12590 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKGGGGSGGGGSGGGGSEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12591 - protein, 658 aa, Artificial Sequence
  Synthetic Polypeptide encoding a CAR and optional  accessory module(s)
MALPVTALLLPLALLLHAARPEIVLTQSPGTLSLSPGEGATLSCRAGQSVRSSYLGWYQQKPGQAPRLLIYGASSRATGIPDRFSGSGSGTDFTLTISRLEPEDFAVYYCQQYGYSPPTFGCGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSSYAMSWVRQAPGKCLEWVSVISGSGGRPNYAESVKGRFTISRDNSKNTLYLQMNSLRDEDTAVYYCAKVDYSNYLFFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12592 - protein, 502 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12593 - protein, 502 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12594 - protein, 678 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12595 - protein, 909 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12596 - protein, 897 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12597 - protein, 862 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12598 - protein, 872 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12599 - protein, 855 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12600 - protein, 847 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12601 - protein, 862 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12602 - protein, 872 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12603 - protein, 855 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12604 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12605 - protein, 625 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12606 - protein, 636 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12607 - protein, 635 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12608 - protein, 631 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12609 - protein, 652 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12610 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12611 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12612 - protein, 1128 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12613 - protein, 1078 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12614 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12615 - protein, 892 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12616 - protein, 1236 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12617 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12618 - protein, 1400 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12619 - protein, 1067 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12620 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12621 - protein, 651 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12622 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12623 - protein, 703 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12624 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKGGGGSGGGGSGGGGSEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12625 - protein, 658 aa, Artificial Sequence
  Synthetic Polypeptide encoding a CAR and optional  accessory module(s)
MALPVTALLLPLALLLHAARPEIVLTQSPGTLSLSPGERATLSCRASQSIRSSYLAWYQQKPGQAPRLLIYGASSRATGIPDRFSGSGSGTDFTLTISRLEPEDFAVYYCQQYGDLPFTFGCGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSSYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12626 - protein, 502 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12627 - protein, 502 aa, Artificial Sequence
  Synthetic Polypeptide encoding a CAR and optional  accessory module(s)
MALPVTALLLPLALLLHAARPEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12628 - protein, 678 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12629 - protein, 909 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12630 - protein, 897 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12631 - protein, 862 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12632 - protein, 872 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12633 - protein, 855 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12634 - protein, 847 aa, Artificial Sequence
  Synthetic Polypeptide encoding a CAR and optional  accessory module(s)
MALPVTALLLPLALLLHAARPEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12635 - protein, 862 aa, Artificial Sequence
  Synthetic Polypeptide encoding a CAR and optional  accessory module(s)
MALPVTALLLPLALLLHAARPEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12636 - protein, 872 aa, Artificial Sequence
  Synthetic Polypeptide encoding a CAR and optional  accessory module(s)
MALPVTALLLPLALLLHAARPEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12637 - protein, 855 aa, Artificial Sequence
  Synthetic Polypeptide encoding a CAR and optional  accessory module(s)
MALPVTALLLPLALLLHAARPEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12638 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12639 - protein, 625 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12640 - protein, 636 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12641 - protein, 635 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12642 - protein, 631 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12643 - protein, 652 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12644 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12645 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12646 - protein, 1128 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12647 - protein, 1078 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12648 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12649 - protein, 892 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12650 - protein, 1236 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12651 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12652 - protein, 1400 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12653 - protein, 1067 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12654 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12655 - protein, 651 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12656 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12657 - protein, 703 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12658 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKGGGGSGGGGSGGGGSEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12659 - protein, 658 aa, Artificial Sequence
  Synthetic Polypeptide encoding a CAR and optional  accessory module(s)
MALPVTALLLPLALLLHAARPEIVLTQSPGTLSLSPGERATLSCRASQSVRSTYLAWYQQKPGQAPRLLIYGASSRATGIPDRFSGSGSGTDFTLTISRLEPEDFAVYSCQQYGDLPFTFGCGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSTYAMSWVRQAPGKCLEWVSAISGSGGRTFYAESVEGRFTISRDNSKNTLYLQMNSLRAEDTAVYYCAKHDYSNYPYFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12660 - protein, 502 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12661 - protein, 502 aa, Artificial Sequence
  Synthetic Polypeptide encoding a CAR and optional  accessory module(s)
MALPVTALLLPLALLLHAARPEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12662 - protein, 678 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12663 - protein, 909 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12664 - protein, 897 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12665 - protein, 862 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12666 - protein, 872 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12667 - protein, 855 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12668 - protein, 847 aa, Artificial Sequence
  Synthetic Polypeptide encoding a CAR and optional  accessory module(s)
MALPVTALLLPLALLLHAARPEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12669 - protein, 862 aa, Artificial Sequence
  Synthetic Polypeptide encoding a CAR and optional  accessory module(s)
MALPVTALLLPLALLLHAARPEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12670 - protein, 872 aa, Artificial Sequence
  Synthetic Polypeptide encoding a CAR and optional  accessory module(s)
MALPVTALLLPLALLLHAARPEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12671 - protein, 855 aa, Artificial Sequence
  Synthetic Polypeptide encoding a CAR and optional  accessory module(s)
MALPVTALLLPLALLLHAARPEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12672 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12673 - protein, 625 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12674 - protein, 636 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12675 - protein, 635 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12676 - protein, 631 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12677 - protein, 652 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12678 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12679 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12680 - protein, 1128 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12681 - protein, 1078 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12682 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12683 - protein, 892 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12684 - protein, 1236 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12685 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12686 - protein, 1400 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12687 - protein, 1067 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12688 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12689 - protein, 651 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12690 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12691 - protein, 703 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12692 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKGGGGSGGGGSGGGGSEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12693 - protein, 658 aa, Artificial Sequence
  Synthetic Polypeptide encoding a CAR and optional  accessory module(s)
MALPVTALLLPLALLLHAARPEIVLTQSPGTLSLSPGERATLSCRASQSVRSSYLAWYQQKPGQAPRLLIYGASSRATGIPDRFSGSGSGTDFTLTISRLEPEDFAVYYCQQYGDLPFTFGCGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLAQPGGSLRLSCAASGFTFSSYAMSWVRQAPGKCLEWVSAISGSGGSTFYAESVKGRFTISRDNSKNTLYLQMNSLRAEDTAVYFCAKHDYSNYPYFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12694 - protein, 502 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12695 - protein, 502 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12696 - protein, 678 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12697 - protein, 909 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12698 - protein, 897 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12699 - protein, 862 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12700 - protein, 872 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12701 - protein, 855 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12702 - protein, 847 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12703 - protein, 862 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12704 - protein, 872 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12705 - protein, 855 aa, Artificial Sequence
  Synthetic Polypeptide encoding a CAR and optional  accessory module(s)
MALPVTALLLPLALLLHAARPEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSGGGGSGGGGSGGGGSEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12706 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12707 - protein, 625 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12708 - protein, 636 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12709 - protein, 635 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12710 - protein, 631 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12711 - protein, 652 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12712 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12713 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12714 - protein, 1128 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12715 - protein, 1078 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12716 - protein, 1074 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12717 - protein, 892 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12718 - protein, 1236 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12719 - protein, 1075 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12720 - protein, 1400 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12721 - protein, 1067 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12722 - protein, 670 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12723 - protein, 651 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12724 - protein, 621 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12725 - protein, 703 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12726 - protein, 719 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKGGGGSGGGGSGGGGSEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12727 - protein, 658 aa, Artificial Sequence
  Synthetic Polypeptide encoding a CAR and optional  accessory module(s)
MALPVTALLLPLALLLHAARPEIVLTQSPGTLSLSPGERATLSCRASQSVRSNYLAWYQQKPGQAPRLLIYGASSRATGIPDRFSGSGSGTDFTLTISRLEPEDFAVYYCQQYGDLPFTFGPGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGMVQPGGSLRLSCAASGFTFSSYAMSWVRQAPGKGLEWVSAISGSGGRTFYAESVEGRFTISRDNSKNTLYLQMNSLRAEDTAVYYCAKHDYSNYPYFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12728 - protein, 503 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12729 - protein, 503 aa, Artificial Sequence
  Synthetic Polypeptide encoding a CAR and optional  accessory module(s)
MALPVTALLLPLALLLHAARPQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12730 - protein, 679 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12731 - protein, 910 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12732 - protein, 898 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12733 - protein, 863 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12734 - protein, 873 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12735 - protein, 856 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12736 - protein, 848 aa, Artificial Sequence
  Synthetic Polypeptide encoding a CAR and optional  accessory module(s)
MALPVTALLLPLALLLHAARPQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12737 - protein, 863 aa, Artificial Sequence
  Synthetic Polypeptide encoding a CAR and optional  accessory module(s)
MALPVTALLLPLALLLHAARPQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12738 - protein, 873 aa, Artificial Sequence
  Synthetic Polypeptide encoding a CAR and optional  accessory module(s)
MALPVTALLLPLALLLHAARPQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12739 - protein, 856 aa, Artificial Sequence
  Synthetic Polypeptide encoding a CAR and optional  accessory module(s)
MALPVTALLLPLALLLHAARPQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSGGGGSGGGGSGGGGSEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12740 - protein, 622 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12741 - protein, 626 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12742 - protein, 637 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12743 - protein, 636 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12744 - protein, 632 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12745 - protein, 653 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12746 - protein, 1075 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12747 - protein, 1076 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12748 - protein, 1129 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12749 - protein, 1079 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12750 - protein, 1075 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12751 - protein, 893 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12752 - protein, 1237 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 12753 - protein, 1076 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12754 - protein, 1401 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 12755 - protein, 1068 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12756 - protein, 671 aa, Artificial Sequence
  Synthetic Polypeptide encoding a CAR and optional  accessory module(s)
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 12757 - protein, 652 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12758 - protein, 622 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 12759 - protein, 704 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12760 - protein, 720 aa, Artificial Sequence
  Synthetic Polypeptide encoding a CAR and optional  accessory module(s)
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKGGGGSGGGGSGGGGSQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 12761 - protein, 659 aa, Artificial Sequence
  Synthetic Polypeptide encoding a CAR and optional  accessory module(s)
MALPVTALLLPLALLLHAARPEIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 12762 - protein, 502 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12763 - protein, 502 aa, Artificial Sequence
  Synthetic Polypeptide encoding a CAR and optional  accessory module(s)
MALPVTALLLPLALLLHAARPQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSGGGGSGGGGSGGGGSEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12764 - protein, 678 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 12765 - protein, 909 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12766 - protein, 897 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12767 - protein, 862 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12768 - protein, 872 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12769 - protein, 855 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12770 - protein, 847 aa, Artificial Sequence
  Synthetic Polypeptide encoding a CAR and optional  accessory module(s)
MALPVTALLLPLALLLHAARPQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSGGGGSGGGGSGGGGSEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLP

SEQ ID NO: 12771 - protein, 862 aa, Artificial Sequence
  Synthetic Polypeptide encoding a CAR and optional  accessory module(s)
MALPVTALLLPLALLLHAARPQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSGGGGSGGGGSGGGGSEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12772 - protein, 872 aa, Artificial Sequence
  Synthetic Polypeptide encoding a CAR and optional  accessory module(s)
MALPVTALLLPLALLLHAARPQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSGGGGSGGGGSGGGGSEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12773 - protein, 855 aa, Artificial Sequence
  Synthetic Polypeptide encoding a CAR and optional  accessory module(s)
MALPVTALLLPLALLLHAARPQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSGGGGSGGGGSGGGGSEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12774 - protein, 621 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12775 - protein, 625 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 12776 - protein, 636 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEPGGGGSPEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRPGGGGSPIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12777 - protein, 635 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEVAALEREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRRVAALKEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12778 - protein, 631 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEAAAKEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREAAAKIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12779 - protein, 652 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREQKLISEEDLGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 12780 - protein, 1074 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12781 - protein, 1075 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12782 - protein, 1128 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 12783 - protein, 1078 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12784 - protein, 1074 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 12785 - protein, 892 aa, Artificial Sequence
  Synthetic Polypeptide encoding a CAR and optional  accessory module(s)
MALPVTALLLPLALLLHAARPEIVMTQSPATLSLSPGERATPSCRASQSVSSYLAWYQQKPGQAPRLLIYDASNRATGIPVRFSGSGSGTDFTLTISSLEPEDFAVYYCLQRTNWPLTFGQGTKVEIKRTVGGGGSGGGGSGGGGSQVQLLESGGGVVQPGRSLRLSCAASGFTFSSYIMHWVRQAPGKGLEWVAVISYDGRNKYYADSVKGRFTISRDNSKNTLYLQMNSLRAEDTAVYYCAKDTDGYDFDYWGQGTMVTVSSTRAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE
